United States Patent 12,491,220 (COMPOSITIONS CONTAINING INDOLE-DERIVED METABOLITES AND METHODS OF USE THEREOF) - sequence listing, part 7

SEQ ID NO: 11 - DNA, 4091145 bp, Bacillus subtilis (residues 2,045,574-4,091,145 of 4,091,145)
  source 1..4091145: mol_type = genomic DNA
agaagcatctgacctatcgggaaaatctgtcaaggaagtagaggatttattagatcttacacctgttctgacagaggagcttatggatctgtcatcatggctgtcggacaaaacgctgtcttttaaaataacggcgcttcaagcaatgctgcctgccgccttaaaggcgaaatatgaaaaagaattaaaaattgcacacggcgccgatcttccgccgcaagtggaacggctgttttctgaaacaaagacgctgctgtattcagatatacccgatcatgatacgctgaaactgattcaaaggcatgttcaaaaaggggccattgacgtgacgtataaagtcgcgcaaaaaaccaataaaaaaatggtcaggcatattcaggcaaatgcgagtaaagaagagcttgctaagcaggctgagggattgtcccgccaagcagcaaaacagcaggcgattcttcactttctcatctctgagccggaaggtgtgaaaattcctgcagcggaattgtgcaaaaaaacggacacgagctctgcaaccatcaaaacccttatccaaaaagggcttttgaaggaaagctatgaagaggtttacagagatccctatcaggacaaaatgttcaaaaaaacagagcccctgccgctgacagacgaacagagggctgcctttgagcccatacgcgagacattggacagcgatgagcataaagtgttcctccttcacggcgtgacaggaagcggaaaaacggaaatttatctgcaatcaattgaaaaagtactggcgaaaggaaaagaagccatcgtcctcgtaccggaaatatcgctgacgccgcaaatggtcaaccgcttcaagggccgcttcggctcccaggtggcagtcatgcacagcggtttatccacaggagaaaaatatgacgagtggcgtaaaatccaccggaaggaagtacggcttgtcgtcggtgccagatccgcgatttttgctccgtttgaaaatctcggaatgataatcatcgatgaagagcacgagtcttcctataaacaggaagaaatgccgcgctatcatgcgaaagaggtggcaatcaagcgggctgagcatcacagctgcccggttgtattagggagtgctacgccgacattagaatcatatgcaagagcgcaaaagggcgtatacgagcttctttcactgaagcaccgtgttaaccatcgggtgatgcccgaggtttcgcttgtcgatatgagagaggagcttagaaacggcaatcgctcgatgttttcagttgaattgatggaaaagcttgaagaaacgattgccaagggtgagcaggcggtgctgtttttaaataagaggggctattcttcctttgtgatgtgcagggattgcggctatgtcccgcaatgcccgcactgcgacatttccatgacgtatcatcgttacggccaaaggctgaaatgccattattgcggacatgaagagcctgttccgcacacttgtcctgaatgcgcaagcgagcatatccgctttttcggaacgggaacacagcgagtggaggaagagctgacaaaagtgctgccaagtgcgagggtgattcggatggatgttgacacgacatcacggaaaggcgcccatgaaaaattactgtcagctttcggagaaggaaaagcggatattcttctcggaacgcaaatgatcgcgaaagggcttgattttccgaatgtcacgcttgtcggagtgttaagtgctgatacaacacttcatattcctgatttcagatcggctgaaaaaacatttcagctgttaacgcaagtcagcggccgggcaggcaggcatgaaaagcccggccatgtcatcattcaaacgtatacaccgtctcattacagtatccagctgacgaagacacacgattatgaaacgttctatcagcatgaaatggcccacaggagagagcaatcctatccgccatactactatttggctcttgtgactgtttctcatgaggaagtggcgaaagcagcggttacagctgaaaagatcgctcattttttgaaagcaaactgcggagctgacacgaaaattctcggacctagcgcgtcgccgatagccaggatcaaagatagatatcgctatcaatgcgtgataaaatacaaacaggaaacccagttatccgctttattgaagaagatactggaacattataaacgcgaaattgaacaaaaacatgtaatgatttcaattgatatgaatccttatatgatgatgtaagatctcacgtcttggagggtaacaaattggcggtaaaaaaggtcgtcacacatcctgcggaggttttggaaacacctgcggaaaccgtgactgtttttgataaaaaattaaaaaaactgcttgacgatatgtacgacaccatgcttgaaatggatggagtcggactggcagcgccgcaaatcggcattttaaaaagagcggccgtcgtagatatcggggatgacagagggagaattgatctcgttaatcctgaaattttagaaaaaagcggcgagcaaaccggaattgaaggatgcttgagctttcctggcgtctatggtgatgtcacacgtgccgattatgtcaaagtgcgcgcgtttaaccgtcagggaaaaccattcattctggaagcgcgaggctttttagcaagagccgtgcagcatgaaatggaccacttagacggtgtgctgtttacatctaaaataagtaaatactatacagaagatgaactagcggatatggaaggatgatttgatgacgagaatcgtatttatgggaacgccggatttttcagttcctgttttaagaaccctgattgaggacggatatgaagtagtgggggtcgtcacacagccggaccgtccgaagggcagaaaaaaagtcatgacacctcctccggtaaaggaagaggcattgcgtcacggcatcccggttcttcagccggaaaaagtcagattgacagaagaaattgagaaagtgctggccttaaagcctgacctgattgtaacggcggcattcggacaaattttgcctaaagagcttctcgacagtccaaaatacggctgcattaacgttcacgcatcccttttgccggaactgcgcggcggtgctccaatccattattccattctgcagggaaagaagaaaaccggggttaccattatgtatatggtagaaaaattggatgccggggacatgatctcaaaagtggaagtggacattgaagaaaccgacaatgtcggaacactgcacgataaattaagcgttgctggcgcgaagctattgtctgaaacggttccaaacgttattgccggcagcatatcacctgaaaagcaggatgaagagaaagcgacgtacgcgcctaatatcaaaagagagcaagagctgctcgactggtccagaacgggcgaagagctttacaaccagatccgcggcttaaatccttggcctgttgcctatacgacgcttaatggacaaaacttgaaaatatgggcgtcgaaaaaaataccggcaccaacaacagctgagcccggcacagtcgttgcggttgaaaaggaagggattatcgttgccacaggtaacgatacggctctgttattaaccgaactccagccggcaggcaagaaacgaatgaaaggcgaagactttgtgcgaggagctcatgttgaagccggtgatgtgttaggagtaaacaatgaaaaaaactagtgttcgtgacatcgcccttgaggcgctgatcaaattagaacaaaaccaggcatacagcaacctgctgctgaaatcggtcattaaatcaaatgaactgagtgatcaggacagagggcttttgactgaacttgtctatggtacattacaaaataagatcgcgcttgattatatgcttaaaccgtttatcaataggcctcaaaaggtaaagccgtgggtgattcagcttcttcgcctatccttatatcaaatggagtatttagagaagattccagacagggcagccatccatgaagcggttgagattgctaaaatccgcggacacaaaggcattgcttcttttgtcaatggcgtgcttcgttctatccagcgcgaaggtgttccatcctttgacgccatcgaagatcctgtacgcaggctggcgacagaaacaagccatccggaatggcttgtgaaagagtgggcggatgcgtatgggtttgaagctgcggaaaagatttgccgtatccacctcattccgccgaagcagacgctgcgtgtcaatcaaatgaaagcagacagagctgagctgcttgaccaaatggctgctgagggaatcgaagttgaaaaaggcgatctcgctgaagatgctgtgaagctcttaaagggatcaattgccggaactcatttcttccaaaacggcgaagtatccatccaggatgagagctccatgctcgtcgcccgcgcccttgatcctaagcctgatgaaacagtgcttgacgcgtgtgcggcgcctggcggcaagtcagctcatatcgcagaattaatgaagaacaaggggagcgttacgtcgcttgatcttcacaaacataaagtgaagctgatcaaagaagcggcaaaccgtcttggcctgacaatcattcatgcggagacaatggatgcgagaaaagcgggggaaacgtttgaaaacgaacagtttgaccggatattggttgatgctccgtgctcaggtttcggtgttatcagaagaaagccggacatgaaatacacgaaaaagcctgacgacagcgcgcgtctagctgaaatccagctgtcgatcctgagggaaatcgcaccattagtaaaaaaaggtggcactcttgtctacagtacgtgtacaatggaccggacagaaaatgatgaagtaatacatgcgtttatacaagaacatcctgattttgaacccgatttgtctcttgaaaagcggctgcctgaaaaggtgagaccctttgttcgggatggaaggcttcaaatccttcctcattatttcggaacagatggtttctttatttgcagcatgagaaagaagggataagcaatggcagaacttaataaaacaaaagtaagaaaagaattgcggacagatcgtccgtcgatttattcttttgaattagacgaaattaaacaatggctgacagacaacggagagaaaccgttccgtgcggctcagatttttgaatggctatatgaaaaacgcgtatcttcttttgaagaaatgacaaacctctcaaaggatctgcgtgagaaattaaacactcactttgtgttaacaacgctgaaaacggctgttaaacaaacctctcaagacggtacgatgaagtttttgtttgagcttcatgacggttataccatcgaaaccgttttaatgagacacgagtatggcaattctgtatgtgtaacgacacaagtcggctgccgtattggctgcacattttgcgcgtcaacgcttggaggcttaaaacgaaaccttgaagcgggggaaattgtcgctcaagtagttaaagtgcaaaaagctcttgatgaaacggatgaacgcgtcagctctgtcgtgatcatgggaatcggtgaaccttttgataactttaacgaaatgctcgctttcttgaaaatcattaaccatgacaagggcctgaatatcggtgctcgccatattacggtctctacgagtggaatcatcccgaaaatttacgaatttgctgatcagcaaatgcagattaactttgcaatttctctgcacgcgccgaacacagaaatcagaagccgtttgatgccgattaacagagcatataaactgcctgatctaatggaagccgttaaatattatattaataaaacaggacgccgtatcagctttgaatacgggctgttcggaggcgtaaacgaccaggtggaacacgccgaagagcttgccgacttgctggaaggagtcaaatgccacgtgaacttgattccggtaaactacgtgcctgaacgggactatgtgcgcacaccgcgtgatcagatttttgcttttgaaaaaacgctgaaatcccgcggagtaaatgtcacaatccgaagagagcaaggacatgacattgacgcagcctgcggtcagcttcgcgcgaaggagcgtcaagacgagacgaggtgatgagggttgttaacagccttaaaaacagatacaggaaaaatccgccagcataatgaagatgatgcggggatattcaaggggaaagatgaatttatattagcggttgtcgctgatggcatgggcggccatcttgctggagatgttgcgagcaagatggctgtgaaagccatgggggagaaatggaatgaagcagagacgattccaactgcgccctcggaatgtgaaaaatggctcattgaacagattctttcggtaaacagcaaaatatacgatcacgctcaagcccacgaagaatgccaaggcatggggacgacgattgtatgtgcgctttttacggggaaaacggtttctgttgcccatatcggagacagcagatgctatttgcttcaggacggtgatttcgttcaagtgacagaagaccattcgcttgtaaatgaactggttcgcactggagagatttccagagaagacgctgaacatcatccgcgaaaaaatgtgttgacgaaggcgcttggaacagaccagtcagtcagtattgacacccgttcctttgatatagaacccggagacaaactgcttctatgttctgacggactgacgaataaagtggaaggcactgaattaaaagacatcctgcaaagcgattcagctcctcaggaaaaagtaaacctgcttgtggacaaagccaatcagaatggcggagaagacaacataacagcagttttgcttgagcttgctttacaagttgaagagggtgaagatcagtgctaatcggcaagcggatcagcgggcgttaccaaattctccgcgttataggcggcgggggaatggccaatgtctatttagctgaggatatcattctagaccgtgaagtcgcaattaaaatcctgcggtttgactatgcaaatgacaatgaatttatcagacgtttccgcagagaagcccaatccgcatcaagcctcgatcacccgaatattgtcagcatttacgatttgggcgaggaagatgatatttattatattgtcatggaatacgttgaaggcatgacgcttaaagaatacataacagcaaatgggccgcttcaccctaaagaagcgctgaacatcatggagcaaattgtctcagccatcgctcatgcccatcaaaaccagattgttcacagagacatcaagccgcataacattttgattgatcatatgggaaatatcaaagtaacggattttggaattgcgacggcactaagttcgaccacaatcacccataccaattcagttctgggctcggtccattacttatcacctgaacaggcccgaggcggcttagccacaaagaaatcggatatttatgcgcttggaatcgttctatttgagcttttaaccggccgtattccgtttgatggagagtcagcagtcagcatcgccttgaagcatcttcaagcggaaactccttcggcaaaaaggtggaatccatcggtcccccaaagcgttgaaaacatcatactcaaggcaactgccaaagatccttttcatcgctacgaaacggctgaagacatggaagcagacataaaaacagcttttgatgccgacagactcaatgaaaagagatttacgattcaagaagatgaagaaatgacaaaagcgatacctatcattaaagatgaagaacttgctaaagctgctggcgaaaaagaagctgaagtgacaaccgcacaagaaaacaaaacaaagaaaaatggcaaaagaaaaaagtggccgtgggttttgctcacgatatgcctcgtttttatcacagctggaattcttgctgtcactgtttttccgtcgcttttcatgcctaaggatgtcaaaatacctgatgtctccggaatggaatacgaaaaagccgcagggctcttggaaaaagaaggtttacaggttgattccgaggtgttggaaatctcagatgaaaaaattgaagagggcctgatggtaaaaacggatcctaaagcggataccacagtcaaagaaggcgccacggtcaccctttataagagcaccggaaaagcaaaaacggagatcggtgatgtgacaggccaaacggtcgaccaggcaaaaaaagcgttgaaggaccaagggtttaaacatgtaacagtaaatgaagtgaatgacgagaaaaatgcgggcactgtcattgaccaaaatccttcagcagggactgagcttgtcccgagtgaagatcaagtcaaacttacagtcagtatcggacccgaagacattacgcttagagacttgaaaacctatagtaaagaagcagcgtctggatatctggaagacaacggattgaagcttgtagaaaaagaagcatactcagatgatgttccagaaggacaggttgtcaaacaaaaaccagcagcaggtacggcagtaaagccgggaaacgaagttgaagtgacattctctctcggaccagagaaaaaacctgcgaaaacagtgaaagaaaaggtcaagatcccctacgaaccagaaaatgaaggggacgagcttcaagtgcaaatcgcggttgacgatgcggatcacagcatctctgacacttacgaagaatttaagataaaagagccgactgaacgaacgatcgaactaatgattgaacccggccaaaaagggtactatcaagtaatggtaaacaataaagttgtcagctacaaaaccattgagtatccgaaagatgaataacaaggagggaaaatatgcctgagggcaaaattattaaggcgctaagcggcttttactatgtactggatgaatcagaggattcagataaagtaatacaatgcagaggaagaggcattttcagaaaaaacaaaattacccctcttgtcggtgattatgttgtgtatcaagctgaaaatgacaaagaaggatatttaatggaaattaaagaaagaaccaacgagcttatcaggccgccaatttgcaacgttgatcaagcggtccttgttttctcagcggttcagccttctttcagcacggcattgctcgaccgcttcctggttctcgttgaggccaatgatattcagccaattatatgcattactaaaatggatctgattgaagatcaagatacagaagatacgatacaagcctatgcagaagactatcggaatattggttatgacgtataccttacctcctctaaggaccaagacagtttaacggacatcatcccgcattttcagaataaaacaacggtatttgccggtcagtccggtgttgggaaatcctcgcttctcaacgcgatcagtccggagctcggattgagaaccaacgagatttccgagcatttgggccgcgggaaacacacaacccgccacgtggagctgattcacacgtccggaggtttggttgcagatacgccgggattcagctcgcttgaatttacagacattgaggaagaagagctgggctataccttccctgatatcagagaaaaaagcgcttcatgcaaatttagaggctgtttacatctgaaagagccgaaatgcgcggtgaaacaagctgttgaagacggggaattaaagcaatatcgctatgaccattatgttgaatttatgacggagattaaagacagaaagccgaggtattagcataatgataaaggttgcaccatctattctttccgctgattttgccgctttaggcaatgagattaaagatgtagaaagaggcggagccgattgtattcatattgatgttatggacggccattttgtcccgaatatcacaatcggtccgctgattgtagaagcggtccggccggtaacggatctgccgcttgatgtccatttaatgatagaagagccggatcgttatatcccggcttttgcgaaagcaggcgcagatatcctgtctgtgcatgctgaggcatgtccgcacctgcaccgtaccatccagctcattaaagagcaaggagtgaaggccggagtagttctaaacccgcatacccctgtacaagtcatcgagcatgttttcgacgatctcgatcttgttcttttaatgacggtgaacccgggcttcggcgggcagaaatttattcattcagtccttcctaagataaaagaggttaagcgaatggcggatgaaaaaggaaaaaaagatctgttaattgaagtagacggcggcgtcaacaaagaaaccgctccgctcgtcattgaagcgggcgcaaatttactcgttgccggttcagctgtttatgggcagtctgaccgcaaaaaagcaatttctgaaatcagaggaagtaaataagcagctttagaaaagagctgggcatacaatagcctaagctctttttcctgtatgcagagaaaggaatcagagatgaaaacaattaatatcgttgcgggaggcccgaaaaatctcatccccgatctaaccggctatacggatgaacacacgctttggatcggtgttgacaaaggcaccgtcactctcttagatgcagggatcatacctgttgaagccttcggagattttgacagcataaccgagcaagaacgccggcgaatagaaaaagccgctcccgcccttcatgtgtatcaagcagaaaaagatcaaacagatttagacctcgcccttgattgggcgctggaaaagcagccggatattattcagattttcggcattacaggcggcagagctgatcattttttaggaaacattcagcttctgtatagaggtgtaaaaacgaacataaaaattaggctgatagacaaacaaaatcatattcaaatgttccctcctggtgaatatgatattgagaaggatgaaaataagcgatatatctccttcataccgttttccgaagacatacatgagctgaccctgaccggttttaaatatcctctaaataattgtcatattacgctcggttcaacactatgtattagtaacgaactcattcattcacgaggtactttttcgtttgcaaaaggcatattaataatgataagaagcacggattaagcatgtgctttcattcaattgctgaaaacaatgaacaaggcggttacgggacgttataggaggggacaaaaatgaaattttacaccattaaattgccgaagtttttaggaggaattgtccgggcgatgctgggctcatttagaaaagattaaggcccaggggttcaaagccctctttcaccacataaaaacgcctgccacatatcggggcaggcgttcattttgttatacacgctcaactttaccggatttcaaagctcgagcagatacatatacttttttaggttttccgttcacaaggatacgaaccttttgaagattcgcgccccaagtgcgcttagaagcgttcattgcgtgagaacggttattcccagctgttgtttttttacctgtgataacgcatttacgtgccatttgtttccctcctcacttgcacaaaacatctactttttaacattcatataatcttagatgctttcgatatggatactttaaataatttaccacagctaaaaaacgtttgcaactattgtttcatcatctttcaagaaaattcacttgacatcttgcggaaacagcagcgctatagtatatgtagaggtacggccagcgattattgcctggtcttttcataatggaaaccatatagtagaatagctgtaactctatgcattcgaaggaggaactagtgtgtccattgaattaagaacgaagtacggacagattgatatatctaatgaagtcatcgcgatggttgcaggaggcgcggcggttgactgttacggcattgtcggcatggcctctaaaaaccagattaaagacggactgactgaaatccttcggaaagagaatttcagcaggggtgtccaagttcgccaagaaggagaacagatacatatcgacatgtatatcattgtcagctacggcacgaaaatttctgaagtggcacataatgtccaaacaaaagtaaagtacacagtaaatcaaaccatcggactggcagtggattctgtcaatatttatgtccaaggcgtacgagtgacgaacccgtagttaggaggagtaggattgtctatcagaacattagacggcagaacctttgccgagatgattcttgcgggagcgcagaatctgtctcaaaacgccagtgcagttgatgcactgaacgtgtttccggtgccggacggtgatacgggaacaaatatgaacctgtcgatgacttccggagcaagagaagttgaacaaatggatacggatgatatcgggaaggtgggctccgcgttatctaaagggctgctcatgggagcacgcggaaattcaggagttatcctatcccaattgttccgcggatttagcaaaaacattgaaacgaaaaaagaaattaatgcacttgagtttgccgctgcgctgcaagcaggtgtagacatggcgtataaagctgtcatgaaacctgtagagggcaccattttaacagttgcaaaagacgctgcaaaaaaagcaatgatcttagcagaaaaagaaaccgatatcactgcgctgatgactgcagtgacagaagaagcagaagcgtctttaaaccgcacccctgaattgctacctgtcctaaaggaagtaggagttgtcgatagcgggggcaaaggcctgctctgtgtgtatgaaggtttccttgcttcattaaaaggtgaaactgtacctcagaaagcagttcttccgtcacttgacgacatggtcagcgcagagcatcacaagagcgcgcaaagcatgatgaataccgaagatattgaatttggattctgtaccgaagtgatggttagacttgatcagacaaaaagagagttcgacgaaggcacgttcaggcaagacctcagccagttcggagattctctgcttgtgattgcggatgaatcgctggcgaaggttcatattcatgctgaagagccgggaaacgtgttaaactacgcccagcattacggtgaattgatcaaaataaaaatagaaaatatgagagaacagcatacctctatcatcagtcaagaaagcaaacctgcagacaacgaaacaccgccggcaaaacagccgtatggcattgtgactgtagcgatgggagaaggaattgcagacctatttaaaagcattggcgcttctgttgtgattgaaggcggccagaccatgaacccaagcactgaggatattgttgatgccgtgaagtctgtaaatgcagatacggtatttatcctgcctaacaactccaacattatcatggctgctaaccaagcggccagcgtagtggatgaacaggtttttgtcattcctgctaaaacggttccgcaagggatgtcagctctgctggcttttaacccggatcaagaagctgaagcgaacgaggccaatatgctaagcgccattcagcaagtaaaaagcggacaggtgacgttctcagtcagagatactcatattgacggtaaagacattaaaaaaggcgactttatgggcattctgaatggaacgattatcggcacttctgaaaatcagctgtcagccgcgaaaatgctgctgtcagaaatgatcggagaagatgatgaaatcgtgaccattctatatggtgaggatgcgtctcaggaagaagctgagcagcttgaagcgtttctcagtgaaaagtacgaggagattgaggttgagatccacaatgggaaacagcctctgtattcgtatatagtttcagcagaatagaagggcaatttgcccttctattcttatgtctgcttttaagtgcggcagcgctgtaacgcgcccgcttgccattttatatctgatcaattagtctagaagcaaagcgctaataagctctggttcataaggaggaatagcatgaaatacagaagcgtttttgatattatcggcccggttatgatcggtccgtccagctctcatacagcgggagctgctagaatcgggagagtggccagaagtttatttggcagagagcctgagcgcatcattgtatctttttacggctcgtttgcggaaacgtataagggccacggcacagatgtcgcgattatcggcggattgcttgattttgatacattcgatgaacggattaaaaccgctatacaaattgcagaagctaaaggaattgatatagagtttcgggtagaagatgcagtcccggtccatccgaacacagcaaaaatcaccatttctgatgaaaagggtgagctggaactgacgggtatttcgattggcggaggaaagattgaaatcacagaattgaatggttttgagctccggctgtcaggaaatcatccggccatactagttgttcataatgacaagtttggcacaattgccggtgttgccaatgttctggcgaaattttcaattaacgtaggacatatggaagtagcccggaaagatatcggccagcttgcgctgatgacaatagaggtcgaccaaaatattgacgaccacattctcgacgagctgtcgaagctgccgaatattattcaagtgacaaagattgctgactagcgaaaagggtcaggaggagccagttatgtttcgtaatgtaaaagaattaattgagattactaaagaaaaacaaatattgatctctgatgtgatgatagctcaagagatggaagtaacagaaaaaacaaaagaggacatttttcagcagatggatcataacctgtctgttatggaagcggcggttcagaaaggactcgagggagttacgagccaaacgggcttaacaggcggagatgccgttaaattgcaggcctatattcgatcaggaaaaagcctgtctggcccgctgattttagatgctgtatcgaaagccgttgcaacaaatgaagtaaatgcagccatgggaaccatctgtgcgacaccgactgcaggttctgccggtgtggtgcccggtacgttatttgctgtaaaagaaaagctgaatccaacaagagaacaaatgatccgctttttgtttacagccggggctttcggatttgtcgtggctaataacgcaagcatttccggcgccgccggaggatgtcaggcagaggttggatcagcttcaggcatggcggctgcggccattgttgaaatggcaggaggaacaccagaacaaagcgcggaagccatggccattacattaaaaaatatgctaggcctcgtgtgcgaccctgttgcagggcttgttgaggtgccttgcgtgaaacggaatgcgatgggcgcgtcaaatgcgatgattgccgctgatatggcattggcgggcattacaagccgtattccatgtgatgaggttatcgatgccatgtataaaataggccaaacgatgccaactgcacttagagaaacaggccagggcggtttagcggcaacaccgacaggaagagaattagagaaaaaaattttcggaggagcgctaggttcacgtgaaacaacatcagcaaactagtatagctaacattaagggtattgggccggaaacagaaaaaacattacacgaactcggtatttatgacatttctgatcttctgaattatttcccttaccgctatgatgactacgagctgagggatttagaagaagtaaagcatgatgaaagagtcacagtcgaagggaaggttcattcagagccttctcttacctattacggaaaaaaacgaaacaggctgacattcaggcttctggtcggccactatttaattacagccgtatgttttaaccggccttatttgaagaagcagctttcgctcggctctgtggtgacggtttcaggtaaatgggacaagcaccgccaaaccatctctgttcaggagttgaaaaacgggccgcatcaagaagacaaaagcattgaaccagtgtattctgtgaaagaaaatgttaccgtcaaaatgatgaggcggtttattcagcaggcgctgacccaatatgcagactcacttcctgatcctcttccggaaaagctaagaaaaagctataaactgcctgactattatcaagcgttaaaagcaatgcaccagcctgaaacaagggaagcattaaagcttgccagacggcggtttgtttatgaagaatttttgttgtttcagttgaaaatgcaggcgttccgaaaggcggaaagagagcagacacaagggatacggcagcgtttttcaaacgaagaactcatgagatttatcaaaagcctcccgtttcccctcacaaacgcccagtcacgcgttcttcgcgaaataacagcagacatgtcttctccatacagaatgaaccgtcttcttcaaggggacgttggatcaggaaaaacggcagtcgccgccattgcactgtatgccgcgatcctatccggataccaaggagcgctcatggtgccgacagaaattctggccgagcagcatgctgattcgctcgtttcgctatttgaaaaatgggacgtcagcgttgctcttttgacaagctctgttaaagggaagcggcgaaaagaactgcttgagcgtcttgcggcgggtgagattgatattcttgtaggaacccacgctttaatccaagacgaggtggagtttaaggcgctgagtctcgttattactgatgaacagcacagatttggagttgagcagcgcaaaaagcttcggaacaaagggcaggatcccgatgttctctttatgacagccactccaatcccaagaacgttagcgatcacagtgttcggtgaaatggatgtatctgtcatcgatgagatgccggctggacgaaagagaatcgaaacctattgggtaaaacatgacatgctggatcgtatattggcatttgtcgaaaaagaattaaagcaaggcaggcaggcttatatcatctgtccgctgattgaagaatcagacaagcttgatgtgcaaaacgccattgacgtgtacaatatgctttctgatatttttcgggggaaatggaatgtcggccttatgcatggaaagctgcattccgatgaaaaagaccaggtcatgagagaattcagcgcaaatcactgtcaaattctcgtatcaaccactgttgtggaggttggcgtgaatgttccgaatgcaacaattatggtgatttatgacgccgaccgtttcgggctatcacagcttcaccagctgcgcggccgtgttggacggggtgagcatcaatctttctgtattctgatggctgatccaaaatcagaaacagggaaagaacggatgaggatcatgtcggagaccaatgacggtttcgagctgtctgaaaaggatctggaactgagaggtcccggtgatttcttcgggaaaaaacaaagcggaatgccggaatttaaagtggcggacatggttcatgattacagagcgcttgaaacggcaaggcaggatgctgcgaatcttgtggcttctgacgcgttctggaaggagccggaatacgctgtgttaagagatgaattgctgaagagcggagtaatggacggggaaaaattaagctgagtatcagaagtttttggtgttcagccagaaacaatcgttgcattccaatctatgaaattatatactactattagtacctagtcttaattgtccggatggtgtttagatatgagaagaaataagagagaacgccaggaattacttcagcagacgattcaagcaaccccctttattacagatgaagaactagcgggtaaattcggggtgagcatccagacgatacgtttggaccgcttagagctttccatacctgaactgagagaaagaattaagaacgtggcagagaaaacacttgaggacgaagtgaagtccctgtcacttgatgaagttatcggagaaattattgaccttgagctggatgatcaggcgatatccattttagaaataaaacaggagcacgtgttcagccggaatcagattgcgagaggacaccatttatttgcacaggcgaattctttggccgttgcagtcattgatgacgagctggcgctgactgcaagtgcagacatccgctttacaagacaggtaaagcagggtgaacgtgtcgtagcaaaagcgaaagtgacggctgtcgaaaaagaaaaaggaagaacggttgtcgaagtgaacagctacgttggcgaagaaattgttttttctggacgctttgacatgtatcgttcaaaacattcataaaggtggagcatgcatgagaatagctgtagatgcaatgggaggagaccacgctcccaaagctgttattgacggagttataaaaggtatagaggcatttgatgatctccatatcacacttgtcggtgacaaaacaacgatagaatcacatttaacaattacatcagatcgcatcacggtgctgcacgcagatgaagtgattgagcctacggatgaacctgtccgtgccgtgcgaagaaaaaagaactcatctatggttcttatggcgcaggaggttgcggaaaacagagctgacgcctgcatttccgcaggaaataccggtgcattaatgacagccggtctctttattgtcggaagaattaaaggaattgaccgtccggcgcttgccccgacacttccgactgtttcgggagacggatttcttctccttgatgtcggcgccaatgtcgatgccaaaccggagcacctcgttcaatatgccatcatgggttctgtttattctcagcaagtgcgcggtgtcacttcaccgagagtcggacttttaaatgtcggaacagaagataaaaaaggaaacgaactgacgaagcagacgtttcaaattttaaaagaaacagcaaacatcaattttatcggaaacgtggaagcgcgagaccttttagatgatgtggcggatgttgtagtaacagacggctttaccgggaatgttacactcaaaacgctggaaggctctgcgttgtctatttttaaaatgatgagagacgtaatgacgtctactttgacatccaagcttgcagcagctgtgctgaagccaaaattgaaagaaatgaaaatgaatatggagtattcgaattatggcggagcaagtctttttggcttaaaagcgcctgtgatcaaggcgcacggctcttcagattcaaatgctgtattccatgcgattcggcaagcaagagagatggtcagccaaaatgtggctgcgctcattcaggaagaagtgaaagaagaaaaaacagatgagtagtctggaggtttttacatcatgagtaagattgcatttttattcccgggtcagggatcacaatttatcggcatgggaaaagagctttatgagcaggtgcctgctgcaaagcgtctgtttgatgaagccgatgaaacgttagaaacaaagctcagctcgcttatttttgagggggctgctgaagaattaacacttacatacaatgcgcagcctgctttgcttacgacaagcatcgctgttcttgagaaatttaaagaatctggcattacacctgatttcacagcaggacacagccttggtgaatattctgcactggttgcggctggcgctctgtctttcaaagatgctgtttataccgtcagaaaacgcggagagtttatgaatgaagcggtaccggctggcgaaggagcaatggctgcgattctcggcatggatgctgaagcattaaagcaagtaaccgataaagtcacagaggaaggcaaccttgtacagcttgcgaatctcaactgtcctggccaaatcgtcatttccggaacagctaaaggggttgagcttgcatctgaactggcaaaagagaacggcgcaaaacgcgcaattccgcttgaagtaagcggtccgttccattctgaactgatgaaaccggctgctgaaaagctgaaagaggtattggacgcctgtgacataaaagacgctgacattccggtcatctcaaatgtttctgctgacgtgatgactgaaaaagcagatatcaaagaaaaacttattgagcagctttactctccggttcgttttgaggaaagcattaacaagctgatcgcagagggtgttacgacttttattgaaatcggtcccggaaaagtgctttcaggccttgtgaaaaaagtaaatagacggttaaaaacaattgctgtatcagatccggaaacgatcgagctggcaattcaaacgcttaaggaggagaatgataatgcttaatgataaaacggctattgtcactggcgcatcccgcggaatcggccgctcaatcgcccttgatctggcaaaaagcggagcaaatgttgtcgtgaactactccggcaatgaagcgaaagcaaatgaagtggtagatgaaatcaaatcaatgggcagaaaagcaattgctgtaaaagcggatgtatcaaatcccgaagatgtacaaaacatgataaaagaaacattgtctgttttttctacgattgacattctagttaataatgcgggaattacaagagacaatctcatcatgagaatgaaagaagacgaatgggatgacgtcattaacattaacctgaagggtgttttcaactgcacaaaagctgttacaagacaaatgatgaaacagcgttcaggccgcattattaacgtatcgtctatcgtcggcgtcagcggaaaccctggacaggccaactacgtggctgcaaaagccggcgtcatcggtttaaccaagtcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgaacctagcgatgtcagcagtgttgtcacgttcctagcttcagagggagcccgttatatgacaggccaaacgcttcatattgacggcggaatggtgatgtaagttttttctcgaaaatttcatcatagtttctctagttttttaaaaacgaatccactataatacttgaggggaggtgaattgctatggcagacacattagagcgtgtaacgaaaatcatcgtagatcgccttggcgttgatgaagcagacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgccgaaacgcggggctttagccctttattcgtgcagttattacagcatgccgcttttacgcgcgctgtatccggtttagtcagagaagcgcggtgaacctgatgtgcctatggaggttactatgtcaaaacactcacattataaagataaaaaaaagttctataaaaaagtagaacaatttaaagagtttcaagaacggatttcggttcactttcaaaatgaaaagcttttgtatcaagcatttacacattcatcttatgtgaatgagcatcggaaaaagccgtatgaagataatgaaaggcttgaatttttaggtgacgctgttttggaactgacgatctccagattcttatttgccaaatacccggctatgagtgaaggagatttgacgaaattgagagccgcaattgtttgcgaaccgtctctcgtttcattggctcacgagctgtcattcggcgatcttgtcctgttgggtaaaggcgaggaaatgacaggcggaagaaagcgtcctgctctattggcggatgtttttgaggcatttatcggagccttgtaccttgaccaaggattagagccggtcgaaagtttcttaaaagtttatgtgttccctaaaattaacgatggtgctttttctcatgtgatggatttcaaaagccagctgcaggaatacgtgcagcgggacggcaaaggctctctggagtataaaatctccaacgaaaaaggacctgcgcacaaccgtgaatttgaagccatcgtatctctaaaaggtgaaccactcggagtcggaaacggccgttcaaagaaagaagccgaacagcacgctgctcaggaagctttagctaaattgcaaaaacaccatacgaaacaataaaatcccccttatgactcagggggatttcagtatgtatgccgtcttatttcaccaatgtttatgatagaattgaaatacttattacataaggaggatcgctatgttcctcaaacgtttagacgttataggatttaaatcatttgcagaacggatttccgtagacttcgttaaaggcgtgacagcagttgtcgggccgaacggaagcggaaaaagcaacatcacggatgccattcgctgggttctcggcgaacaatcggcacgctctcttcgcggcggaaaaatggaggacattatttttgccgggagtgattcaagaaagcgattaaatctagctgaagttacgcttactcttgataatgatgatcatttcttgccaattgacttccacgaggtgagtgtcacaagacgtgtgtacagatcaggtgagagtgagtttctgattaacaatcagccatgccgcttgaaagatattattgatttatttatggactctgggcttggtaaagaagcattttctattatcagccaagggaaagtggaagagatcctgagcagcaaagcggaggatcgccgcagtatctttgaagaagcggccggggtgcttaaatataaaacgagaaagaaaaaagcagaaaataaactgtttgagacacaggacaatctaaatcgggtagaagatatattacatgagcttgaaggacaggttgaacctcttaaaattcaagcttcaatagcgaaagactatcttgagaaaaagaaagagctggagcatgttgaaattgcgctgactgcctatgatatcgaagagctgcatggtaaatggtcgactcttaaagagaaagtgcagatggcaaaagaagaagagcttgctgaatcgtctgctatttctgcgaaagaagcaaagattgaggatacaagggacaaaatacaagcgcttgatgagtcagtagatgagctccagcaagttttactggtaactagtgaagagctggaaaagctcgaaggccgtaaagaagtcctgaaagaacgaaagaaaaacgctgtgcaaaaccaagaacagcttgaagaagccatcgttcagttccagcaaaaagaaacggttctgaaagatgagctttcgaagcaggaagctgtcttcgaaacgcttcaggctgaggtgaagcagttaagggagcaagtaaaagaaaaacagcgggctctcagtcttcacaatgaaaatgtcgaagagaaaatcgagcagctgaaaagtgattattttgagctgttaaacagccaggcttcgatacgcaacgaactccagcttcttgatgaccagatgtcccaatccgctgtcacattgcaaagactcgcggacaacaatgaaaagcacctgcaggaacggcgtgatatttctgcgcgtaaagccgcatgtgaaacggaattcgcccgaattgagcaggagattcacaatcaagtcggtgcatatcgtgatatgcagacaaaatatgagcagaaaaagcgccaatacgaaaaaaatgaatccgctctgtatcaggcataccaatacgttcagcaagcgagatcaaaaaaggacatgcttgagacgatgcagggagatttttccggcttttatcaaggtgttaaagaagtgctgaaagcgaaagagcgccttggtggaattcgcggagcggttcttgagctgatttctacagaacagaagtatgaaacggccattgaaatagcgctcggcgcttctgctcagcatgtcgtgaccgacgatgaacaatctgcccgaaaagcgattcaatatttaaagcagaattccttcggccgggcgacgtttctgcctctttctgttattagagaccgccagcttcaaagccgtgacgcggaaacagccgcccggcattcatcatttctcggggttgccagtgaacttgtcacatttgatcctgcgtatcgaagcgtcatccaaaatcttcttggaaccgttctgatcacagaggacttaaagggtgcaaacgagcttgcgaagcttctcgggcaccggtaccgcatcgtaacccttgagggagatgttgtgaaccccggtggttcaatgacgggcggcgcggttaaaaagaaaaataactccctccttggaagaagccgggagctagaagatgtgaccaaacggctcgctgaaatggaagagaaaacagcactgcttgaacaagaggtcaaaacccttaagcaatccattcaggatatggagaaaaaactggctgacttaagagaaaccggggaaggcttaaggttaaagcagcaggatgtgaaaggccagctatacgaacttcaagttgccgagaaaaatatcaatacccatttagagctctatgaccaagaaaaatctgctctgtctgaaagcgatgaagagaaaaaagcgcgcaaacgcaagcttgaagaagagctctctgccgtatctgaaaagatgaaacagcttgaagaggacatagacagactgacaaaacaaaaacaaacgcaatcctcaacgaaagagtctctctccaacgagctgactgagctgaagatcgctgcggccaaaaaagagcaggcttgcaagggggaagaggacaaccttgccagattaaagaaagagctcactgaaacagagcttgcgttaaaagaagcaaaagaagacttaagcttcttaacgtcagagatgtcatctagcaccagcggcgaagaaaagctggaagaagcagcaaaacataaattgaatgacaaaacgaaaacgatcgaactgattgcattaaggcgcgatcagcgcatcaagcttcagcatggacttgatacgtatgagcgtgagctgaaagaaatgaaacgcctgtataaacaaaaaacaacgctcttaaaagacgaagaagtcaaactcggacgaatggaagtcgagcttgataatttactccaatacttacgggaggaatacagcttgtcctttgagggggcaaaagagaaatatcagcttgaaactgatccagaggaagccagaaagcgcgtgaagctgattaaactcgcaattgaagagctgggtaccgtgaacctcggaagcatagatgagtttgagagggtcaacgaacggtacaagtttctgtcggaacaaaaagaagatttaacagaagcgaaaaataccttgttccaagtgattgaagaaatggatgaagaaatgacgaagcgctttaacgacacatttgtccaaatccgctcacactttgatcaagttttccgctccttattcggaggagggcgagctgaactgaggctcaccgatcctaacgatctgcttcattcaggagtcgagattatcgctcagccgccggggaaaaagctgcaaaacttaaacctcctgtcaggcggagagcgtgcgcttactgctatagcgctcttattctcaatcctaaaggttcgtccagtgccgttttgcgtccttgacgaagtagaggctgcgctcgacgaagcgaatgtgttccgatttgcgcagtatttaaaaaaatacagcagtgatacccagtttattgtgattacccacagaaaaggaacgatggaggaagcggatgtgctttatggcgtaaccatgcaggaatccggtgtttccaaggtaatctccgttaagctggaagaaacaaaagaattcgttcagtaacgaggaaagaggttaaatgatgagcttttttaaaaaattaaaagagaaaatcacaaaacagacagattccgtatctgaaaagtttaaggatggccttgaaaaaacaagaaactcctttcaaaacaaagtgaatgatcttgtatcccgttaccgtaaagtggatgaggatttcttcgaagagcttgaagaggttcttatcagcgcggatgtcggttttacgaccgttatggaattaatagatgagctgaaaaaagaagtcaaacgcagaaatattcaagatccaaaggaagtccagtcagtgatttctgagaaactggtcgagatttataacagcggagatgagcaaatttcagaactgaacatccaggatgggcgtttaaacgtaatccttctggtaggtgtaaacggcgtcgggaaaacaacaacgatcggaaagcttgcccataaaatgaaacaagaaggaaaatctgtcgtacttgccgccggagacacttttagagcgggagccattgaacagctggaagtatggggagagcgtacaggagtgcctgtcattaagcagacggccggaagcgatccggcagctgtcatctacgatgctgttcatgctgcgaaagcaagaaatgccgatgtattaatttgtgatacggcaggtcgtctccaaaacaaagtaaatctcatgaaagagcttgaaaaagtaaaacgtgttatcgaaagagaagttcctgaagctccgcatgaggtgctgcttgcccttgatgccacgaccggccaaaatgcaatggctcaggcaaaagagttctcgaaagcaacaaatgttaccggcattgctttaacgaagcttgacggtacggcaaagggcggtatcgtccttgcgattcgcaacgagcttcacatcccggttaaactagtcggtttaggagaaaaagttgatgatcttcaggaatttgatccagaatcctatgtgtacggactcttttcagatttagtggaaaaagccgacgattaagaaaaaggccccaacatcttggggccttttcttttttatcttcttacttgataggcgaaatgataaaggctgttatcagtggataccagtcttgactcaccagaaaaaactctgaatgggatgatgtcatagtaatgaacggaaacagatgtgtaatacgtgtaatacccagcagctggccccaaatacattggaacctcaaatgttccgtttgcatcagtcgttcctgaagcagtttgtgttgtgtttccgaccttcgtgtccgcttcaaatcttacgggcgcgtttggcactggctgtccgttttggtcgagtaatttgccgcttactgtaatattgtacttgactcgccaatattgaccttgtccgtaattgattttaccgtatacccctccatctgtgctgatatttgtgattgaggccttataaggtgcctcagcagcgtctgcttgctgtgccgggaaacctattgtaaacagggctgccagacacaacataaacaataaaccgatttttttcataaaaatcctcctttaaatagggttcatatacaatatcggaataaattggatgacatttagcgttttttggaaaaagttaatcgccgctttgacaagataaaaacttgacagtctcaacaaaaccgtgtaaactaagttatcgtaaagggatttgacttaacaaaggggagagctcaaatgtcactcgaaaagacaacgagaatgaattatctgtttgatttttatcagtcgttgttgacgtcaaaacagaagagctatatgtcgctttattatttggacgatttctccctaggcgaaatagccgaagaatatgaggtttcaagacaagctgtttatgataacatcaaacgaacagaagcgatgcttgaacaatatgaagataagctgctccttttgaaaaagtttcaggagcgtaaagagatgtttaataagctgaaggagcttgcttccggttcaaaagaagaggaagaaattacagctctgattgaagcgcttgagaaattagattaggaggcggcaaactatggcatttgaaggattagccgaccgactgcagcagacgatttctaaaatccgcggaaaagggaaagtcagcgaacaagatgtaaaagatatgatgcgtgaggttcgtcttgcgctgcttgaggctgacgttaactttaaagtagtcaaagattttgtcaaaaaagtaagtgaacgcgctgtaggccaagacgtcatgaaaagtctgacgcccggccagcaggtcattaaagttgttaaagaggaactgactgagctgatgggcggcgaagagagcaaaatcgccgtcgcaaaaaggccgccgactgttattatgatggtcggtctccaaggtgccggtaaaacgacaacaagcggtaagcttgcgaatctgctgcgcaaaaagcataatcgcaaaccgatgctggttgctgccgatatttaccgcccagccgcaattaagcagctggaaacactcggcaaacagcttgatatgcctgttttctctcttggcgatcaggtcagtcctgtagaaatagctaaacaggctattgagaaagccaaggaagaacattatgactatgtcattttggatacggcaggccgcttgcatatcgaccatgaactgatggatgaactgaccaacgtcaaagaaatcgcgaatccggaagaaattttcctggttgtcgattcaatgaccggtcaggacgctgtgaatgttgccaaaagctttaatgaacagctcggtttaaccggtgttgtgttaactaagctggatggagacacacgcggcggggctgcgctttctattcgcgctgtcacaaacacgccaattaagttcgcaggtttgggcgaaaagcttgatgcgttagagccgttccaccctgaacgcatggcatcaaggattctcggcatgggcgacgtgctgacattgattgaaaaagcacaggccagcgttgatgaagacaaagccaaagagctggaacaaaaaatgagaacgatgagcttcacattggacgattttctggagcagctcgggcaagtcagaaacatggggccgcttgatgagcttctgcaaatgatgcctggtgcaggtaaaatgaaaggcctgaaaaacatccaagttgatgaaaaacagctgaatcatgtggaagcaatcattaaatcaatgactgttcttgaaaaagaacagccggatatcatcaatgccagccggcggaagcggattgcaaaaggaagcgggacatccgtacaggaagtcaaccgtctgcttaagcagtttgatgaaatgaaaaaaatgatgaagcagatgacaaacatgtcaaaaggcaagaaaaaagggtttaagctaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccacgtgacggccgtttcatcgaaacagtcggaacttacaacccggttgcaaaaccagcggaagtaaaaattgacgaagagcttgctcttaaatggcttcaaactggagcgaaaccatctgatacagttcgcaacttgttctctagccaaggaatcatggaaaaattccacaacgctaaacaaggcaagtaatgactgatcaacacttggaagatttgattgtccacattgtgacgccgcttgttgatcatccagatgacattcgcgtcataagagaagaaaccgatcaaaagattgcgctgcgcttatctgtccataagtcagataccggtaaagttatcggaaagcaaggccggactgcaaaagcgattcgaacagctgtatttgcagctggcgcacagtcttctaagaaagttcaatttgaaatatttgactaaaagggagagggccggcacctcccctttttttacacgcaaaaaaagggtaaactgatagaagcttaggcaaaatagaaaagcctgggcgagtaaaagttttaaaagcggggagcttggtgcgatgcaaattattcaccgtgtagccgttatgcaagtcttaaccgagcgcagtaaagaaaagcttttagcttcttttgccgaaaagaaacaaatgcttgaacgagaatgcagccagctctattttcagcttagaaaacatgagaaagaacagcaaaaccctgatatgatagaacaatttaaaaaggcaatagaaaagcgaaaagatgatatgaaaatcatcgattttcaaattgctcaagtacatacattgccgcttggcagtgagttgaaagaaaaggaagtcgatgcgctgctgacgattgaagccggggatgactggcatgagaaaacagcagcgaacaccatcgtcataaaagacggaaaagtaattgaaattcgccagaggtgatcatatgacaaagcgatggtttaatgtaggcaaaatcgtaaatacccacggaatcaaaggcgaagtgcgggtgatttcaaaaacagattttgccgaagaacgatacaagccgggaaacacgctgtatttgtttatggacggccgtaacgaaccagtggaggtaacggtaaacacacatagactgcataagcaatttcatctcctgcagtttaaagaaagacaaaacctaaatgaagtagaagagctgaaaaacgcaatcattaaagttcctgaagaagaattaggagagctgaatgagggtgaattttatttccacgaaattattgggtgtgaagtatttactgaagaaggcgaactcatcggaaaggtcaaagaaattttgacgcctggagccaatgacgtttgggtcatcggacgaaaaggaaaaaaagacgcactcattccttacattgaatcagtggtcaaacatatcgatgtcagggaaaagaaaattgagattgaactcatggaagggttaatagacgaatgaaaatcgactttttgacgctgtttcccgaaatgtttgaaggcgtgctcggctcatcgattcttcaaaaagcccaggaaaaagatgcggtgcagtttcaagtcgtaaatttccgggagtactctgataacaagcacaatactgttgatgattatccttatggcggcggggcaggcatggttctcaagcctcagcctgtttttgacgcggtcgaggacctgacatcaaaggcagccgctgctccgcgtattatcctcgtatgcccgcaaggtgagcgttttacccaaaaaaaagccgaacaattagcaaaggaagagcatttgctgttcatttgcggccactatgaaggctatgatgaacgcattcgcgagcacttggtaacagatgaaatatcaattggcgattttgttctgacgggcggtgagctccctgcaatgatgatcgcagacagtgtggtcagactgcttccgggtgtactggggaaagaggcttcccatattgaggattcattcagcaccggactcttagagcacccgcattatacaagaccggcagattacaaaggtttaaaagtgcctgaaacactcttgtcaggaaaccatgcaaaaattgaagaatggcggaataaagaatcgatcagaaggacctacctaagacgtccggatctgttgaaagactacccgcttacagagcagcaaagaaagtggatttctgaatgggaaaaagaatagattttattgcataggctatgaaattgtgataagatactacttgtggcttaagcgggcttatccgctgcaagcttgaaaacgatgttccgctgtgcctgtttttgtggccaagagcatctgttggaaggagttgaaaacgatgcaaaaactaattgaagatatcacaaaagaacagcttcgtactgatcttcctgcgttccgtcctggtgacactttacgtgtacacgttaaagttgttgagggtaaccgtgagcgtatccagatctttgaaggtgttgtgattaagcgtcgtggtggtggaatcagcgaaacgttcacagttcgtaagatttcttacggtgttggcgttgaacgtactttcccagtacacacaccaaaaatcgcgaaaatcgaagttgtacgttacggtaaagtacgccgtgctaaactttactacctgcgtgaacttcgtggaaaagcggctcgtattaaagagatcagacgataatgataacgaacgaaaagagcttgttacctgtaacaagctctttttttatacagaatttgaaaatgccggacaggcatcgtaaaatacataaaggacaacaatgaatcatgcatactgaagataaaggcggtgttcgtgtcacatgacaattcaatggttcccgggccatatggcaaaagcaagaagggaagtaaccgaaaaattaaaattaatcgatatcgtatatgaattggtagatgccagaattccaatgtcatcaagaaacccaatgattgaagatattctaaaaaataagccgcgaattatgctgttaaacaaggctgacaaagcagatgcggcagttactcagcggtggaaagagcactttgagaaccaggggatccgctctttgtccattaattctgtaaatggacaagggttaaatcaaattgtgcctgcatcaaaagagatccttcaagaaaaatttgaccggatgcgtgcgaaaggtgtgaagccgagagcgattcgcgctttgattatcggcattccaaacgtcggaaaatcaacgctcatcaaccggcttgcaaagaaaaacatagcaaaaacgggagacagacctggtattacgacttctcaacagtgggtcaaagttggaaaagaattagagctattagatacaccgggaattttgtggcctaaatttgaggatgagcttgtcggtttaagacttgcagtcaccggggctattaaagactcgattatcaatttgcaggacgtggcggtgtttggtcttcgttttctcgaagaacattacccagaacggcttaaagagcgttatggccttgaggagattccggaggacattgccgagctgtttgatgcaataggtgaaaagcgcggctgtctcatgagcggtgggctcattaactatgataagacgactgaagtcatcattcgcgatattcgcactgaaaagttcggcaggctgtcatttgaacagccgacaatgtaaaggcgcgcagaaatgcgggtctttattttttcttggctgaaccgatacatacagtaagggagaagagaaagtgaatacattaaccgtaaaggacattaaaggccgtttgcaggaagtgaaggatgcacaagacccatttattgcccaatgcgaaaacgacccgagaaaaagcgttcaaacgcttgtagagcaatggcttaaaaagcaagcaaaagaaaaagcgctgaaagaacaatgggtgaatatgacttcctatgaaaggctggcaagaaacaagggatttcgtttgattgcaggtgttgacgaggtcggccggggaccattggcaggaccagttgtcgccagcgcagtcatccttccagaggaatgtgaaatacttgggctgacagactccaaaaagctttcagagaaaaaacgcgaggaatattacgagcttattatgaaggaagcactggcggtcgggataggaattgtagaagctactgtgattgatgagatcaatatatatgaagcttcaaaaatggcaatggtgaaagcgatacaggatttgtcggatacacctgattatttgcttgttgacgcaatgacacttccgctcgacacggctcaggcgtcaattataaaaggcgatgccaaaagcgtgtctattgcggcaggtgcgtgtatcgcaaaagtgacgagggaccgaatgatgagcgcttatgccgaaacgtatcccatgtacggctttgaaaaaaataaaggctatgggacaaaagaacatttggaagctctcgctgcatacggcccaactgaattgcaccgcaaaactttcgctcctgttcaatctttcagataaatcaccatggacaaggaggcacctttttaaaatgaacatacgaaatgatgtgcaaaaggcgctgcagcacctttttgggcgtacagccgtcccgcaggaaacatcaaaagtaaacgaagcgctaaacggggagaagcgtctcctcttaggaaaagtgcttcgtttactaggagatcagcatgctcttatccaagtcggcaatcaaactgttcagggaaaacttgaaacccagcttcgccttcaggcatactattggttttcctacgaaaaaaaaacggcagaacaaacaggccgtcttcaggtcgttcaaagctttgaccaaaatcctaaaaccattcaggatgcagctggcaagcttttaaatgccatttcagtgaagccgtcaaacgcagctctcatgatgacaggagcaatgctgaagagcaaaacacccgtaacagaaaatgatatcaagacagctgtccgctggatggacacgctgccttcgcaagacacaaaaaaagcggttgagacggttctcttcgctttaaagcgtgatcttcccattcactccgaggttttgaatggtgttcatgccgtgaaatcacctgttccgttgcatcagcacgtatcccagctgcttcaggcaatcgaccaaaaccctcagcagagccaaatgatgtcaaagctaaaggaagcagttacggcgcttttaaatagtgaaatcgatgtccatgcagaacggctgattgataagcttatttctttaaccgataatacaaaagcgccttctccggccaatacagctggaagcagggagcttagcacaccagctggctcccccggaaaagcccgccagccgatggcaaatcacacagcagaacagagaagcatacaagaagagcctgttaaaacagcagcagacattccaattaaagaagcccgccagctgctggtcaagctgacggaatctgctgaaaaaaacagtctccaaattgtgaaagaagcagcaaattggattaaagcggctgcttcatcgggtgatagtaagtcacttgcagcttcagccgttttacaggaggcacaagtcacagaccaggaagctgaagtctttttaaaggctgttcagcagacagcaccccatttggcggataaagcagatgttctttctttcttatccaaagtgaaaacggcaatcggcgcaagggatgaggttgcgttcattaaagcgtttgaacaaggaagcgcagtcacatctggagaaatgcaatccatcaagctggctctttctgccttaagagcatcgcatgaggtagccgaaccagtcaaacaagaagccgatcagctctttcataaattaaatggccagcttttcatgcagcaggaccatccgtcatacagccaaattgtaatgtcatttccgatgttttcgaagtcaggggttcaggacatgactgttctgtttacaggaaagaaagaagcggatggaaagcttgacccttcccattgccgccttttatttttgctgcagcttgatacactaaaagaaaccgtcgttgattgcttggtacagcaaaaagtcatgaccattacaatagagactgatttcgagctgcaggctgcgatcgatccgatggtgcccgcgcttaaacaagggctaaaggaaatggggtacagcctttcaggggtaaacgctaaaaaaagggttcacaccgaagaaaaggcttcaatcgatcaatatataacaagtatcagtgatcaggaagtggatgtgaaaatatgaaagagcagacaccgatcagaaaagctgttgctctccattatgacgaacaaaaagacaaggcgccgagagtgattgccacagggaagggccatgtagctgacaacattatcaaagaagcgaaaaaagcaggggtcccgattcaagaagatcggacccttgtcgaattaatgcgccatttgacggtagatgatcaaattcctgaagctctttatgaaacggtagccgagattttttcattcatttacaaattggacgaaagcgtaaaaaacaaaaaatagctaaaatattccccatccttctttgaaatttatgtttttaataaagtaaaagtttgaatgtttagaaggattaaaagattttgcatcgaactgtagacaattcttccagtattattatagaatgaaagcgcagtctattttagttttgttacataagttaggaggatgggaaatgaatatccatgagtaccagggaaaagaagtcctcagaaaatatggggtatctgttcctgaaggtaaagtggcttttacagcagaagaagcagttgagagtgcaaagagcttatccagctcggtttatgtcgtaaaggctcaaattcatgctggcggtcgaggcaaagctggtggggtaaaaatagcaaaatcattagacgaagtaaaagcgtatgccgaagaactattagggaagaccctagttacacatcagacgggtccggacggccaagtaataaaacgcttacttattgaagaaggctgcgatattaaaaaagaatattacatcggtctagtgcttgaccgcgccacttcaagaatcgttttaatggcttctgaagaaggcggaacggaaattgaagaggttgcggagaaaacaccagaaaaaatcaaaaaagctgtcattgatccggctgttggccttcaaggctatcaagccagagaaattgcattcgctattaatattccaaaagagctcgtgggaaaagctgctaaatttatgcttggactatataaagcgtttgttgagaaagactgctcaatcgccgaaatcaatccgcttgttgtgactggcgacggaaatgtgatggcgcttgatgcaaaattgaattttgacagcaatgcgttgtaccgacaaaaggacattatggaatacagagatttggatgaagaagatccgaaagaaattgaagcgtccaaatatgatctaagctacatttcccttgatggaaatatcggctgtatggtaaacggcgcggggcttgcaatgtccacgatggatattatcaagcattatggaggagaaccggccaacttccttgatgtgggcggcggtgcaaccgctgaaaaagtcacggaagcatttaaaatcattctttctgatcaaaacgttaaagggatttttgtcaacattttcggcggcattatgaaatgtgatgtcatcgcagaaggggttgttgaagcgactagacaagttggtttgacattgccgcttgtcgtccgtcttgaaggcacaaacgtggatctagggaagaaaatccttagtgaatcaggattaaacattacatctgcggaatcaatggctgacggcgcgcagaaaatcgtatccttagtttaagaaagaatgaaaggcaggggaccaaataatgagtgttttcattaataaagatacaagagttattgtgcaagggattacaggttctaccgctttatttcatacgaagcagatgcttgaatacggcacaaatatcgttggcggtgtaacacctggaaaaggcggaacagaagcggaaggtgttcctgtatttaatacagtggctgaagcagttcaaacgaccggcgctaacgcgtctgttatatatgtgcccgcaccgtttgcagctgatgcgattatggaagcggtagatgcggagctggatctcgtgatttgtatcacagaacatatcccggttttggatatggtgaaggtcaaacgcttcatggaaggcaagaaaacgagactgatagggccgaactgtcctggtgtcattacgcctgaagaatgtaaaatcggcattatgcccggatacatccataaaaagggtcatgtaggcgttgtatcacgttcaggaacattaacatacgaagcggtgcaccagctctcagaagcgggtgtagggcaatctacagctgttggaatcggcggcgaccctgtaaatggaacaaactttattgacgttttaaaagcgtttaacgaagatcctgacacacacgcagtcatcatgattggcgaaatcggcggtacggccgaagaggaagcggcagagtgggtaaaagccaacatgacaaaaccggtagtcggttttatcggcggtaaaacagcacctcctgggaagcgcatggggcatgcaggcgccattatttccggcggaaaagggacagctgatgaaaaaatcaaaacccttaatgcatgcggaatcgaagttgcagagacaccttctgtcatgggtgaaaccttaatcaaggtgctgaaagagaagaacttgttcgaaacttgtaaaacgcattaataaaaaagggacagccgtcaaggctgttcctgctttttctaacaaaaggaggtcaatctattggatcaggccgctgcctgcctaacgatttgcagaatcaatcaattattatccccatcccttctattaaaatggtggaaagccgatccgtctatgtcgctgacatcacctgtgttacaaacggttactcgtgatcaaataaaagcagctgcattaaaaaacgaaatagaacaactttatccaaagctccagcgtgtacttgctgcttatcgtgagcaaggcattaacaccatccctatttcttcaaagcaatatcctttctggcttaaaagcatttatgatccccccgccgtactgtttgcaaaaggtgatatgactcttctttcgaaagggagaaaaattggaattgtagggacaagaaatccaacagcttatgggaaacaagttgtcaatcatcttacaaaagagatctgtcgtaaaggttgggtgattgtcagcggactggcgtctgggatagacggaatgtcccatgctgcaagtattaaggcgaaggggcggacaattggcgtcattgcaggcggatttcagcacatttatccccgagaaaaccttcagttagcagatcacatggctaaacaccatatcctgctgtcagagcacccacctgaaactaaaccccaaaaatggcatttccctatgagaaaccgtattatcagcggactaagtgaaggcgttattgtcgttcagggcaaagaaaaaagcggttcgctgattactgcctatcaagcattggaacaagggagagaggtatttgccgtacccggttcattgtttgacccttacgccggaggtcctataaaactgatccagcagggggctaaagccatatggtcagcagaggatattttcgaggaacttcctgagagaaacgttcaatatacggaacccttttgaattatcgtttgacaaacggtattgtaatatttaataatagtgaggatttaaagttgcatattgttttctatttaattaatgacgttcatgataaagaatgaaatgttgaaagccaaataaagacagctgcaaaaataaaattgaaatatcttgaaaagagagagaacacctcttgagggggatgaaaatgtctgattatctagtcatcgtggaatcgcccgctaaggcgaaaacgattgaacgttacttaggtaaaaaatataaagtaaaagcatcaatgggacatgtccgggatcttccaaaaagtcaaatgggagttgacatagaacagaattttgaaccgaaatatattaccattcgaggtaaaggcccggtattaaaagagctgaaaacggctgcgaaaaaagccaaaaaagtgtatctcgcagccgaccccgacagagaaggggaagcgattgcatggcatttggcacacagtcttgatttagatctcaactcagactgccgtgtggtgtttaacgaaattacaaaagacgctattaaggaatcgtttaagcatccccgcatgatcaatatggatttagtggatgcacagcaagcgagacgtattttagacaggcttgtcggatataaaatcagtccaatcttatggaaaaaagtcaaaaaagggcttagcgcaggacgcgtgcaatccgttgccctccgtttgattattgaccgtgaaaaagagattaacgactttaagcctgaggaatattggacaattgacggtacgttcttaaaaggtcaagaaacctttgaagcgagctttttcgggaaaaacggcaaaaaacttcctttaaatagtgaagctgatgtaaaagagattctttctcagctcaaagggaatcaatatacagttgaaaaagtaaccaaaaaggaacgcaaacgtaatcccgctttgccttttaccacttctaccctgcagcaggaagcggctcgcaagctcaatttcagagcgaagaaaacgatgatgattgcacagcaattatatgaaggaattgatttaggaagagaaggaacggttggtctgatcacgtatatgagaacggattcaacccgtatttcaaatacggctgttgatgaagcagctgcatttattgatcagacatatggaaaagagttcctaggcggaaaacggaagcctgcgaaaaagaatgaaaatgcccaggatgcccacgaagcaattcggccgacatcagttcttagaaaaccaagtgaattaaaagcagtcctcggcagagaccaaatgagactgtataaattaatttgggagcgttttgttgccagccaaatggcaccggctgttctcgatacaatgagtgtcgacctgacaaacaacggtttgacatttcgtgcaaatggaagtaaagtcaagttttccgggtttatgaaggtgtatgttgaaggaaaagacgatcaaatggaagaaaaagaccggatgctgcctgacttacaagaaggcgacacggtattatcaaaagatatagaacctgagcagcattttacccagccgcctccgcgatatactgaggcccggctcgttaagacccttgaagaacgcggtatcggccgtccatccacatatgctccgacacttgatactattcagcggcgcggctacgtggcattggataataaacgtttcgttccgactgaattaggtcagatcgttcttgacttgatcatggagtttttccctgagatcattaacgttgagtttacagctaaaatggagagagatcttgatcatgttgaagaaggaaataccgaatgggttaagattatcgataatttctacaccgattttgaaaaacgcgtcaaaaaagccgaatcggaaatgaaggaagttgagattgaaccagagtatgctggagaggattgtgaattgtgcagttctccaatggtatataaaatgggacggtacggtaaattcttagcttgctctaacttccctgactgccggaacacgaaaccgattgtgaaacaaattggtgtgaagtgcccgagctgcggagaaggaaacattgttgagcgaaaatcgaaaaagaaacgggtgttttacggctgtgaccgttatccggactgtgaattcgtatcatgggacaaaccaattgaacgaaaatgcccgaaatgcggaaaaatgctcgtcgagaaaaaactcaaaaaaggcatacaagtccaatgcgtggaatgcgattataaggaagaaccacagaagtagcggtgagcagggtcttgctcaccttctttgtgtgttaaaagaaggccttgaataataaactaggagatgtgaaagatgaaccaacgaacagtgaatgtaatcggagccggacttgcaggaagtgaagcagcatggcagcttgccaagcgagggattcaagtcaaattgtatgaaatgcggccagttaaacaaacgcctgcgcaccatacagataaatttgcagagcttgtctgcagcaactctcttcgctctaatacgcttgctaacgctgtcggtgtattaaaggaagaaatgcgtgcacttgattcagccattatcgctgcggctgacgaatgttcggtgcctgccgggggcgctcttgcagtggaccgtcatgaattttcggcaagtgtgacaaatcgggtgaaaaatcatccaaacgtaatcgttattaatgaagaagtgactgaaattcctgaaggccctactatcatcgcaacgggtccgttaacatctgaatcgctgtctgcccagctgaaggagctgactggagaggactatttatatttttatgacgcagcggcgccgattgtagaaaaagacagccttgatatggataaagtgtatctgaaatcccgttatgataaaggtgaagcagcatatttgaactgcccgatgacagaagaagagtttgaccgttttcatgaagcattaacatcagcagaaacagtgccgttaaaagaatttgaaaaagagattttctttgaaggctgcatgccgattgaagtcatggcaaaacggggtaagaaaacaatgcttttcggtccgatgaaaccggttggtctagagcatcctgttacaggaaaacgcccttatgctgtcgttcagctcagacaagatgatgctgcgggaacactttataatattgtaggattccagacacatttaaaatggggagaccaaaaggaagttctcaagttgattccaggacttgaaaatgtagaaatcgtcagatatggcgtgatgcatagaaacacatttattaactctccaagcctgttaaagccgacttatcaatttaaaaaccgcagtgatctgttctttgcaggccaaatgacgggagtagaaggatatgtggaatcagctgcctcaggacttgtagcaggcattaatgcggcgaagcttgtattgggagaagagcttgtgatcttccctcaggaaacagcaattggcagtatggcacattatattacaacaacaaaccagaagaacttccagccgatgaatgcaaactttgggcttttgaaagaattgccagttaaaattaaaaataaaaaagaacgaaatgaacaatacgcgaaccgtgcgattgaaacaattcaaacaatttcgaaaacaatataggtattgattgcaacctgagcgcgatttgtgataccatttaaaagcccttcctggggaggtattaggcatggagaatgttaagaatttcgtaaagttattcgttgaatatttacaaattgaaaaaaattattcacaatatactattgtgaattatgtggattcaattgaagaattcgagactttcctgcgcgttcaaggtataaatggatttgaagaagctgcatatcaagatactaggatttttttgacagaagcctatgaaaaaggtttatcgagaagaacaataagcaaaaagatatctgcattaagaagcttttataagtttctgatgcgggaaaagcttattgaagaaaatccgtttcagcttgttcatctgccaaaacaggagaaacggataccgaagtttctatatcaaaaagagcttgaggagctgtttgaagtttcagatataagccagccggccggaatgagggatcaagcgctgttagagctgctctatgccaccggaatgagggtcagtgaatgctgttccataactattaacgacgttgatttatttatggacactgtgcttgttcacggcaaaggcaagaagcagcgctatatcccctttgggtcttatgcccgcgaagcgttgaaggtatacatgaatagcggaagacagtgcttgctgatgaaggcaaaagaacctcatgatctattattcgtaaatcaaagaggcggaccgcttacagcccgtggcatcagacatattttaagcgggcttgttcaaaaagcgtcaagcactttacatatccatccgcatatgcttcgacatacgttcgccacgcatctgttaaatgaaggagcggatttgagaagcgttcaagaactgctcgggcattccaatctgtcttctacacagatatacacgcacgtttcgaaggaaatgttgagaaacacatatatgtctcaccatccaagagcatttaagaaaaattaaaggaggccctttatgtcatcttttcatgcgaccacaatatttgccgtacagcataaaggacgaagcgctatgtccggagacggccaagtaacatttggtcaggctgttgtcatgaaacacacggcacggaaagtgagaaaactgtttaacggcaaagttcttgctggctttgcgggatctgttgcagacgctttcactttattcgaaaagtttgaagctaagcttgaagaatataacggcaacttaaaacgggcggctgttgagcttgcgaaggaatggcgcagtgataaagtgctaagaaagctcgaagccatgctgattgttatgaatcaggatactttgcttctcgtatcgggaacaggcgaggtgatcgaaccagatgacggcattctcgcgattggatcaggaggcaattacgctttggcagcgggaagagcactgaaaaagcatgccggtgaaagcatgtctgcaagtgagattgccagagccgcgttagaaacagcaggcgaaatttgtgtttacacgaacgatcaaatcatactggaagagcttgaatagaaaggacttgaggcgcatggaaaaaaaaccgttaactcctagacagattgtagatcggttagaccaatatattgtcggtcagcaaaatgcgaaaaaagctgtcgccgtggcattaagaaaccgctatagaagaagtcttctggatgaaaagctgaaggacgaggtcgttccgaaaaacattttaatgatgggtcctaccggcgttgggaaaactgaaattgccagacgaatcgctaagctttcaggtgcgccatttatcaaaattgaagctactaaatttaccgaagtcggctatgtaggcagagatgttgaatcaatggtcagagatcttgtggagacttctgttcggcttatcaaagaagagaaaatgaatgaagtaaaggaacaggcagaagaaaatgcaaacaaacgcattgttcgtctgttagttcccgggaagaaaaaacaatctggcgttaaaaatccgtttgaaatgttttttggaggcagccagccgaatggtgaagatgaggcggagagccaggaagaagcaaacatcgaagaaaaaagaaaacgaatggcgcatcagctggctttaggagagctcgaagactactatgtaacagtagaagtcgaagagcagcagccttctatgtttgacatgctgcagggctcgggtatggagcagatgggtatgaacatgcaggatgcgctgagcggattaatgccaaagaaaaagaaacggcgcaaaatgacagtcagagaagccagaaaagtcctgacgaatgaagaagcaagcaaactcatcgatatggatgaagtcagccaggaagctgttcagagagcagaagagagcgggattatctttatcgatgagattgataaaatcgcaaagaacggcggtgcatcttcttctgccgatgtttcaagagaaggcgttcagcgggatattctgccgattgttgagggctcaaccgttgtcacaaaatatggttctgtaaaaacagaccatgtattatttattgcagcaggagcgtttcatatggctaaaccgtctgatttgattcctgagctgcaggggcgtttcccgattcgtgtagaactgaacaaactcacggtagacgacttcgtgagaattttggttgagccggataatgcgctgctgaaacaatatcaggcattattgcagacagaaggtatatctcttgaattttctgacgaagctattcataagattgctgaagttgcttatcatgtgaaccaggacacagataatatcggtgcgagacgccttcatacaatacttgaacgcctattagaagatttgtcgtttgaagctccagatgtaacgatggagaaaataacgattacaccacagtatgtcgaagaaaagctcggaacgatagccaaaaacaaagatttaagtcaatttatattgtgaaaaatttaatatgaggaatgtttaggaggattatttatcatggctttattacaaaaaacaagaattattaactccatgctgcaagctgcggcagggaaaccggtaaacttcaaggaaatggcggagacgctgcgggatgtaattgattccaatattttcgttgtaagccgcagagggaaactccttgggtattctattaaccagcaaattgaaaatgatcgtatgaaaaaaatgcttgaggatcgtcaattccctgaagagtatacgaaaaatctgtttaatgtccctgaaacatcttctaacttggatattaatagtgaatatactgctttccctgttgagaacagagatctgttccaagctggtttaacaacaattgtgccgatcatcggaggcggggaaagattaggaacacttattctttcacgtttacaagatcaattcaatgacgatgacttaattctagcagaatacggcgcaacagttgtcggaatggaaatcctaagagaaaaagcagaagaaattgaagaggaagcaagaagcaaagctgtcgtacaaatggctatcagctcgctttcttacagtgagcttgaagcaattgagcacatttttgaggagcttgacggaaacgaaggtcttcttgttgcaagtaaaattgctgaccgtgtcggcattacccgttctgttattgtgaacgcactcagaaagctggagagcgccggtgttatcgagtctagatcattaggaatgaaaggtacttatatcaaggtgctaaacaacaaattcttaattgaattagaaaatctaaaatctcattaatcacaaaaagaaccctttttgagggttctttttttattttaaataaaggaaatcaataagctttatttcctgggttgaaagtctttctatgtaataattttaataaattttgcatttttcttcaaaaagtttcaaaaatgccgaaaagaaaagagaaaaaacagaaattctgctattttcaggcttatatcaaggtgagaaatgtagttctaacaatctaggactttatacctagttgtaaaatagataattgtgaggacatttttttacacgaacttcatagactttatgcctgttatttcttacaataagcatatagttttacaattctcgacaaggatattgagggtgaaaaaaactgaaatggaggtaagtggatttgagcttattttctggaacgatacaaaatcttgaaaatgccttgagtagagcggatattaagcaaaaagtcataactaataatatcgccaatatagatacaccgaactataaggcaaaaaaagtctctttccaaaatttattagatcaagaatcttcgcgtcttgaagcgataaaaacagactatcgtcatgttgatttttctgatactgattcgaattattcaattgttgcgagcggagatacatcgtatcagcaaaacggaaacaatgttgatgttgacaaagagatgacagaattggcgcaaaatcaaatcaactatcaagctttggttgaaagaatgaacggtaaatttaattcgctgaagaccgtattaacaggaggaaaatgatgacagcttttcatagcttaaatgtttcagcatcggctttaacagctcagcgagtcagaatggacgttgtatcatctaacttagcaaatatggatacgacaagagctaagcaggtgaatggagagtgggtgccttacagaaggaaaatggtctcccttcagtcaaaaggtgaatcgttctcttccattctcaattctcaaatgagcggaagcggtagtgctggaaacggtgtgaaggtttcaaaaattacggaggatgattcggattttaatcttgtctatgatccgacagaccctgatgcaaacgctgaaggatatgtacaaaagcctaatgttgatccattaaaggaaatggttgatcttgtcagcagcaccagatcatatgaggcgaatgtcacggcgatgaatgctacaaagggaatgctgatgaaggcgttagaaatcggaaagtaggtgaatgaatgtgattaatgcaatttctccttttcaggttcaaaatactcaaaacactcaaaatgcaacaaatcaagtaaacaatagccaaaaaacagattcttcaaatcaaacaagcttttcggagcttttaaaaaactctattagttcgttaaatgagtcccaagtagcttctgacaacatgactaatgccttggctgcaggaaaagatgtaaatcttgatgaggtcatgatcgctgctcaaaaagctagcatctctctaactgcagcaacagagttccgcaataaagctgtggaagcttatcaggagattatgagaatgcaaatgtagggggtctgacgatttagagaaagagtggaatgaccgggggttaacatgaatcgtactctaatgcaaatgaaaaacaaaacgagtgagttttggaaaaatagatctaaactacaaaagattttaatggttagtgctttagcggcaattattattattggaattattattagtgtttttgcttcaaattctaaaatggcgccgctgtacaaagatttgtctgctgaagaagcaggacaaatcaaaaaagaattggatgcaaaaaaagttccaaacgaactttcgaatggcggtacagtgattagtgttccggaggatcaggttgattctttgaaagtgcagatggctgcagaaggacttcctaaaacgggatcaattgattattcgttttttggacagaatgccggctttggtttgacagacaatgagtttgatatggtgaaagtgaaagctacacagacagaactgtcaaacttgatcaatgaaatggacggtattaaaaattcaaaagtaatgattaatctcccgaaagacgctgtgtttgtcggtgaggagcaatctgcagcatctgcatcaatcgttctgcagattcaaccgggttatacacttgatcaaagccaaatcaacggattatatcatctggtatctaaaagcgtgccaaacctaaaagaagataacatcgtcatcatggaccaaaattctacatactacgacaaatcagacagcgatgcagggtcctacgcggatagttattcttctcagcaaggaattaagtctcaagttgaaaaagacattcaaaaacatgtacagtcactgctgggtacgatgatgggccaagataaagtcgttgtctccgttacagcagacattgatttcacaaaagaaaatcggacagaagacattgtcgaacctgtggataaagaaaacatggaaggtattgcagtcagcgctgaaaaggtatctgaaacatatcagggcgacggtgcagccaacggcggaactgccggaaccggcgaggaagatgttacaaattataaggctgacggtgaaaataccgaaagcgggaactacgaaaaaaacagcaacaaaatcaattacgaggttaaccgaattcataaagaaatcgctgaaagtccttataaggtcagagatttagggattcaagtaatggtagagccgcctgatgccaaaaacactgcgtcgctatcaactgaaagacaggatgatatacaaaaaatcctttcaactgtagtcagaacatctttggataaagatgaaacgcaaaatcagaatttatctgatgctgatatcaataataagattgttgtttccgttcagccattcgacggaaaagtcaatttggatacaaatacggaagaatcctcaggtatcccgctgtgggcatatattgtaggcggtgttttaatcgcagcgatcattgttctgatcattatgcttatcagaaagaaacgggcgcaagaggatgaatttgaggaatatgagtatgaggttcctcaagaaccaatcaatttgcctgatatcaacgaagaggaaaatgaaacagcggaatcagtcagacgaaaacagcttgaaaagatggcgaaagacaagccggaagattttgcaaaactgctgagaagctggctggccgaggattaggaggaattagaaatggcgagacgtgatcaagataagcttacaggaaaacaaaaagcagccattctcatgatttccttggggttagatgtgtcagcttctgtctataagcacttaaccgatgaagaaattgaaaggcttactctggaaatatcaggtgttcgaagcgtcgatcatcaaaaaaaggatgaaatcatagaagaatttcataatatagccattgcgcaagattatatttctcaaggcggtttaagctatgcaagacaagttctggaaaaggcgcttggagaggataaggcggagaacattctaaacaggctgacttcttctttgcaggttaaaccatttgattttgccagaaaagcggagcctgaacaaattttgaattttatccagcaagagcatccgcagacgatggcgttaatcttgtcttatttagatccagtgcaggctgggcaaattttatccgagctgaatcctgaagtacaggctgaggttgcgagaagaatcgcggtcatggatagaacgtctccagaaataattaatgaggtagaacggattctggaacaaaaattatcttctgcatttactcaggattatacacaaacaggcggaattgaagctgttgtggaagtgttaaacggggtagacagagggacagagaagacgatcttggattcattggaaattcaggatcccgatcttgctgaagagattaaaaagcggatgtttgtcttcgaagatattgtcacacttgataaccgtgccattcagagagtcattcgcgatgttgagaacgacgatttgctcctttcattaaaggttgcaagcgaggaagtcaaagaaattgtattcaacaatatgtcacagcgtatggttgaaaccttcaaagaagaaatggaatttatgggccctgtacgcttgaaagatgttgaagaagctcaatcgagaattgtaagcatcgtcagaaagcttgaagaagccggtgaaattgtaatagcaagaggcggaggggatgatattattgtctaatatcattaaacaagaatcatctatttctccacaaaaggaaaaaagaaaactttctatacaagaggtgcgtattgatcattctcaccttttgcaggctgaagagaacccggaggcgcttatggcccgagtgaaagaggaagctgaccggatttctgagcaggcaaacagtcatatagaaaatattcgccgtcaaattgaacaggagaaaaacgattgggcggctgaaaaacagaagcttattgaagaagcaaaagccgagggctttgaacaaggagtagcgctgggcaaagctgaggcaatgaaacagtatgccgaactgatcggccaagcaaacagtataactgaaatgtccagaaaagctgttgaggacaagcttgaagacgctaatgaagaaatcgttgagcttgccgttgccctagcaaaaaaagtttggcagcaaaagtctgatgataaagaggctttcctcctgcttgtacaacaggttataaacgaagtgaaggaatatgacgatatatcaatttatgttgatccatattactatgagacaatctttcagcaaaaagatgaaatccagcagcttctttataaagaatgccggcttggcatatatgctgatgaaaaagctcaaaaaggaacctgttatattgaaactccttttggcagggtagatgcgagtgttgacacacaattgatgcaattgaaagataaacttctgacagcgctggaagcaggtgcagctgaatgaagacacagagtctgatagattgtatagaaatgacagactcgtataaacgatacggaaaagtcaagcgggtaatcggcctgatgattgaatcaaaagggccagcaagctcaattggcgacgtgtgcctgatttatgcaaaaggacaatctgggaaagtcattaaagctgaggtagtcggcttccaggaagaaaatattttgcttatgccttatttagaggctgcgagcattgcacctggcagcattgtagaagctactggggaatcacttcgggttaaagttggaacgggactgatcggacaagtcatcgatgcttttggagaaccgcttgacggaaaacttctgccgaaagggctttcgcctgtatcaacggagcaatcaccgcccaacccgatgaaacggccgcctatccgtgaaaagatgggtgttggagtcagatcaattgacagcttgctgacagtcgggaaaggccagcggattggaatttttgcaggaagcggtgtcggaaaaagcacattaatggggatgatcgccaagcagacagaggctgacttaaacgtcattgcacttgtcggagaacgcggacgagaggttcgggagtttattgaaaaagatcttgggaaagaggggctgaaacgatcgattgtagttgttgccacctcagaccagccagcattaatgagattgaaagcggcatatacagcgactgcaattgccgagtatttccgagataaaggccaaaatgtcatgtttatgatggattctgttacaagggtggcaatggcgcagcgagagattggattggctgccggagagcctccgacaacaaaaggctatacaccttcagtgttcgctattttacctcgtttactagaacgaacaggtgcaaacgagcatggaaccattacggcattttatacagtgttggtagacggggatgacatgaatgagccgattgccgatactgtacgcggaattttagacggacatattgtgttggatagggcgcttgccaataaaggtcagtttccagcagttaacgtactaaaaagcatcagcagggtgatgtcaaacatatcgacaagacagcatctggatgcggcaaataaattccgtgaacttttatcgacatatcaaaattcggaagatctcattaatatcggagcttacaaaagaggatcatccagagaaattgatgaagcgatacagttttatccgcagcttattcaatttttaaagcagggaacagacgaaccggctttattggaagaaagcattgctgtattaactagtttgacaggaaatgaggaataaacgtggcttatcaatttagattccaaaagctactggaactaaaagaaaatgaaaaagaccaatccttatccgagtatcagcaatcagtttctgaatttgaaaacgttgctgaaaaattatatgaaaatatgagcaaaaaagaattgctagaacaaaataaggaaaagaaattaaaaagcggcatgagtgtacaagaaatgaggcactaccaacaatttgtctcaaatcttgataatacgatctatcactatcaaaagcttgtcattatgaaaagaaatcaaatgaatcaaaaacaagaaattttgacagagaaaaacattgaagtgaaaaagtttgaaaaaatgcgtgaaaaacagtttaaaatgtttgctcttgaagataaagctgcagaaatgaaagaaatggacgatatttcgattaagcagtttatgattcaaggccattaggagcgaatgtaatgtccggcaaaaagaaagaatcaggtaagttccgttcggttttgcttatcattatcctcccgctgatgtttctactaatcgcaggggggattgttctttgggctgctggtatcaatgtcttaaagccgatacaggatgctgcggcaaaaacgccggttcttaaagaattggtccctgaaaccgaaaataaaaaagacacagcatcaaataaggatagcagtaatacagcagctctggaaaagaccattaaggatcaaaaaagtgaaatcggtatattgaataaagatttagaaacaagtaaatcggaaatcgataggctcaatcaaaagatccgttcacttgaaaagacagctgaggatcaaaaaaagtcatcagaagatcatactgaaggatcagcagactcgaaagcttcatctgaaaatgacaaagtgatcagtgtgtacaaaagcatggacagcggaaaggctgctaaaattattgcccaattaaaggagaaagaagcactgaaaatattgaatggcctaagcaaaaagcagcttgctgacatattggcgaaaatgactcctgagcaagcagcaacctatacagaaaaaattgctgccagccaagaatagggggaatgaaaggtgaagctgcttgaattagcgggacctttgctgcaaaccacaacgggttctgccgctaaaaacatgaaaagtagccggggagtttttcaaaactggcttatttctgaggcaggattgaaggaactctcagaacaaggaaagggaactcctaattccgaagatcagcttttagcagatgcgcttaaaaagatcggtgaatggctaaatgcaagtcctgaagaccaagacaaacaaaatgcggatcttttgcaaacattaagcaaactgacagggaagcaattggatgcgaatgctctgcaaatattgcaaaatcttttgcaagcagttgaatcaaaaatgtcaagcgggacggatcaattgctcacagaaacggagaaaatcttttcagaagctaaaacggctcggaatgccaatgattctgtttctgacattaatggagcactgaagtcggatacagagcaatcaaatcaggaaaatgaagtatccgatgctgctaaagagcttatctatatccagatgttcattagccagctcgtagaagggaataagctgactgatcgcgggaatggcaatgaagctcatgccatttaccaaaatggagatcaattcctatctgcattagaaaaaaagggtgtatctcaacaactcattcaggatcttaaacagcaaatattcactaaagctgagtcaagttcaaaactttactccatgacagcgtcagagctgaaaagttttcaaagcttaatggaccaaatgtctatgcttcctcaaaaagggaccaaagaatggagtctagctgaaagccagctgaaagccttcttgttatcgaaatcatccgaatcatcacaagactttgggaagcgtgttctcacaccgctttcgcagagttcatccagcaaaaatgcatcggatgtttctggaagtattcagcctgtagatagtaaatcaggactccaaatgctgttttcggggcatcggagcataggaggagttcaaacactagatctgcagcagatgtcatctgatataccaaatgccgaaacaaaaacggtggctgatcaagtgattaatgcgtggaagcagatgaaatatacgcctttcggcagatcgacgggaagtttcactattcggctgaaccctgaacatttaggatttgtcacaatcaagctgacaaatgaaaatggaatgtttcagagtaaaatcatagcatctagccaatcagcaaaagaattgcttgaacagcatcttcctcagctgaagcaatcattgccgaatatggccgtccaaattgaccgttttactcttccggtccaaagcggggatcagccgatatacggccagcttgctgatgaacagaaacagcagcaagaggggcagagacagcaaagacagaaaaagcaatcaaatgattttggcgatctgctcgatgaagtgtcgatggttgaaatggaggaagaagaatgacttctataagttcagaatataaactgcctgaaaaaacgaacactgtgtcgacgaacaacagcagcttggggaaagacgagtttttaaaaatattaatgactcaagttcaaaaccaagatccgcttaacccgattgacgataaagaatttatcagccagatggcgactttttcaagcttggagcaaatgatgaatctgaatacgacaatgactcaattcgttgaaaaccaagatccgtttacaacgtatgttgattggatgggaaaagaagtatcttggactgatggtaaaagtgcaacagataaaacaggcacagtaagctctgttaaacattttaaaggaaattattatctcgttcttgatgatgggaccgagatcagtcctgcgaatgtcatgtctgtgggacaatcatctaaataaaaacatctgggggaatatattatgttacgttcactttattctggaatcagcggtatgaagaactttcaaacaaagcttgacgtaatcggtaacaacattgccaacgtaaatacagtaggattcaaaaagagccgtgtgacctttaaagatatggtaagccaaacgattgccggcggttctgctgctggtgcaacaatcggcggaacaaactctaagcaaatcggtttaggttcatcatctggcacaattgatacaattcattcaacaagcgcgacacaaagtacaggaagaacacttgatttagcaattgacggcgacggttacttccgaattgatacaggtgacgggacagcttatacaagagcagggaacttctatttagataataccggaacactggttacaggtgatggctaccatgtgttaaatatgaatgggggaacaattaaaattcctactgatgctcaaagctttagcattggttctgatggaaaggtgtcaattgttgatgctgaggggaaaacacaagacgggggacaaatcgggattgttacttttgccaacagtgatggattggataaaatcggaagcaacctataccgtgaatctttaaactctggaacggccagtgcagcgaaccagcctggtgacggcggaactggtgctcttaaatcaggatttctcgaaatgtctaacgtcgatttaactgacgaatttactgaaatgatcgtagcccagcgcggattccaatcaaactcaaaaattattacaacatctgatgaaatccttcaagaactggttaaccttaaacgttaaggagggaggggaggcgagtaatcgcttctccgctgttttatgattaaagtaacccgtttgaacgggcagccctttacactgaatgcgctatttattgaacagattgaatgttttccggatactacaattactctgtcaaatggtaagaagtttgtagtaaaagaagatgaagaagctgttctggaaaagatcgcagctttctaccgaaaaatacaaatatttgcaatggatcaaggaatagaggaaccggaatgaagaaaaagttaatgatcatattactaattattcttatcgtaattggtgctctcggggcggcggcttattttgttttaggcggaaagtccgaaaaaagtgaagcgaaaaaaagtattgatgaaatcgttgcgtcttctgttgatgtagaagagatcacaacaaatttaaagtctgataacattatccgtcttgctattaaacttgaaactgattctgataaatcaaaagaagaacttgagaaacgtgatttccaagtgaaagacgctgttatatcactgctggctgatacgaatgctgatcagattgagggagacaagggaaaagaaacctttaagaaggaactaaaagataaaataaatagctacctccaagaaggaaaagtagaaaaagtgtacattacctcctttaatctgcaataaagcataatttgacagaatacggaggtgaggaaaatgtcaggagaagttctctcccaaaatgaaatagatgcactgctttctgcaatatcaacaggtgaaatggacgctgaagagctgaaaaaagaagaaaaagagaagaaagtcaaggtttatgatttcaaacgtgcgctgcggttttctaaggatcagatccgcagtttaacgagaattcatgacaattttgcaagacttcttaccactcatttttctgctcagctcagaacctatattcacatatctgtcagttctgttgaccaggtcccgtatgaggaatttatcagatcgatcccgaacatgacgattctgaatctatttgatgtccatccgatggaaggcagaattatgatggaggtcaaccccacgatagcttatacgatgatggatcgggtcatgggcgggattggaatcagtcataacaaggttgacagtttgacagaaattgaaacaaaaatcatttctaatttatttgaaaatgcactgggtaattataaagaagcttggcagtcaattgctgatattgaaccggaaatgactgagtttgaagtgaatccgcaatttgttcagatggtatctcctaatgaaacagtcgtggtgatctcgctcaatactcaaattggtgaaatcagcggtgtcattaatctctgtatcccgcatatcgtactcgagccgctcataccgaagctttcagtccactattggatgcaatcagaccgaaatgagccaaagcctgaggaaacaaagtcgcttgaaaaacgtatcatgacagcacaaatacctgtcgtggccgagctcggcacatctgaactgacgatagaagagtttttaagtttagaagtcggagactgcataactttggacaaatcagtcacggatcctcttactgtattggtcggagataagccgaaatttttaggacaagccggccgggtgaatcgaaaacaggcagtgcaaattttagatcacgacataagaggtgaacaagatggagaataatagattatctcaagatgagattgacgcgcttcttaacggtactggcagcacgcttgatgagccagaggttccggaagtagatgacttatcggaaatggagcgtgatgcgatcggtgaaatcggtaatatttcattcggcagttctgcgacagcactttcaacgcttttaaatcaaaaggtcgatattacgactccaagcgtaacggtcattccaagaagtaaaatcagcgatgcgtttcctgaaccgtatgtagcgattgaagtgaattatacggagggcttcagcggaagcaacctgttagtcgtggaacaaagtgacgcggcgatcattgctgacttaatgatcgggggagacggaaaaggcgcggacccttcactgggtgaaatccatttaagtgcggttcaagaagcaatgaaccaaatgatgggatcggctgccacatcaatgtctactgtattcagtaaaaaaattgatatttcacctcctcgggttgaattgttggatgttactgaagaaaagggtacagaccgtattcctgatgatgaaatgctggtgaaagtttctttcaacttaaaggtgggagaattaatagactccagcattatgcagctttacccattgacatttgcgaaagatttaatttcaagccttatgaactcagaaagtgcagaggaagaagaaacggtgcagcctgaagttacatacgaacagccgaaagagcctgtgacgccagagccgcgtattgaaccgaagcaacagcagcagccgccaaaaaggcagggaacagcaaaaaaagcagcgccagttcaggtttcaccggtggaattttccgcgtttgatccaaacgaagctgtacaagcccctattcataatctggatatgcttttggatatcccgctttcgattactgttgagcttggcagaacgaagagaagcgtaaaagagattttagagctttctgccggaagtattatcgagcttgataaattagctggtgagcctgtagatattttagttaatcagcgtatcgttgccaaaggcgaggtcgttgtcattgaagaaaacttcggagtaagagtcactgacattttaagccaggcagagcgcattaataatttaaaataacgaaacacaaggagagagatagattatggcacatagaattttaattgtagatgacgcagcatttatgagaatgatgattaaagatattttagttaaaaatggttttgaagttgtggcggaagctgaaaatggagcacaagcggtagagaaatataaagagcattcacctgaccttgttactatggatatcacgatgccagaaatggatggtattacagcattaaaagaaattaaacaaattgatgcgcaggcaagaatcatcatgtgttctgctatgggacagcaatcaatggttattgatgccattcaggccggcgctaaggatttcattgtgaaacctttccaagctgaccgtgtgcttgaagcaatcaacaaaacattaagttaaagggtgtacgactgttgaaaaagagtcaatattttattgtttttatttgttttttcgttttattcagtgtacatccgattgctgctgccgcggcagactctgataattcaactgtaaacgaatggtttcaaaagaaagatgaaaaaactgcagatcaatcagagcaaaagaaagaaaaaacaacaaaaactgctgatgagacggagggagcggctgctccttctgtctcagcttttgattttgtaaagatgattttcgctttactgtttgttatcgcgctgatttacgggctggttaagctcatgaacaaaagaaatcggctcctaaagccttttcaatatgttgaaaatattggcggtacatcggtcggccagaacagatccatacaattgatcaaggtcgggaaaagtgtgctcgtcgtcggtgtaggagagacgatccagctgctgaaagaaattgaggatgaaaaagagattgaagtcattctcagtcagcatgaagaggcaatgtcaagcaaaatagagtggcaaaagtttgtgaagccgcttaagagttctgaacatcagccgcagcaaaaactgccttcattttcaaaagcattaaaagagcaacttgaagagttaaaacaaaaccgttctgaaggaaagaagaaaggcccacgtcatcatgaatgagtttataaatattttcagttcaagcgatccggaaaacgtaagttcaactgttaaattactattattgttaactgtattttcagtggcgcctggaatattgattcttatgacttgttttactcgcatcgtcattgttctgtcatttgtcagaacttcacttgcgacgcaatctatgcccccaaaccaggttcttatcgggcttgcgctgtttttaacattttttattatggctcctactttttcagaaattaataaagaagcgctgaccccattaatggacaacaaaatcagcttggatgaagcgtatacgaaagctgaggaaccgattaaagaatttatgagtaaacacacaaggcagaaggatctggcgctgtttatgaattacgcgaaaatggataaacctgaatcattaaaggatattccgttaacaacaatggttccggcttttgccatatcggagcttaaaacagcatttcaaataggttttatgatttttatcccttttttaattatagatatggtagtggcgagcgtcttgatgtcaatggggatgatgatgctgcctccagttatgatttctctgccctttaaaatattactttttgttttggtagacggctggtatttaattgtgaaatctttgcttcagagcttttagggtaggtgctaaacgtgagttcagaatttgtaatttctatggcggaaaaagccgtatacgtaacgctgatgatcagcgggccattattggctattgctttactggtcggtttaattgtcagcatatttcaggcgacaactcaaatccaggaacagactttggcgtttattccgaaaatcgtggcggttctcctggctctcattttttttggtccgtggatgctgtcgacgattctttcatttacaacagagctgttttctaatttaaatcgttttgcagggtaatgtagagatgaattcaattattgacttatttcctgcttttttattggtttttattagaatctctgctttttttgtaacaattccgctatttggacatcgaaatgtgccagctgttcatcgcataggttttgctttttttcttgcggtcatttgtttcagcaccattgataaaccgccctctttggagatagatgagcactatatgcttttggcgtttaaagaagctttggtcggcctatgtctgggtttaattgcttatatgatgattgccgcagtgcagattgccggctcgtttattgattttcaaatgggattttcaatagcaaacgttattgatccgcaaaccggtgcacaaagtccgttgattggccagtttatctatacgatggcacttttgtttatgctgagtgtcaatgcccaccatttgttgctggatggtatttactacagctttcagtatatttcagttgatcaggcatttccgaatttcggcgatgaaaagtttgcctattttatggcgaaaagctttaatgcaatgtttattatcgcttttcaaatgtcagcgccggttgtggccagtttgtttctagttgatttagcattaggcatcgtggctcgaactgttccgcagttaaatgtatttgtggtcggtctgcctttaaagatcgctgtcagtttcatcatgctcattgtatgtatgtccgttatcttcgtcgttgtccggaatgttttcagtttaacgattgaaacgatgcggaatcttttagcattggtcggtgtttcttaatgaagcttagagttgacctgcagttttttgcgggagagaagacagaaaaagccactccgaaaaaacggaaggatacgcgaaaaaaagggcaggtagccaaaagctcggatgtcaataccgccgtttctttactggtaatattcctttcgcttattgcaattggtccgtatatgagagacaggctgctgtcattcatagaaacattttataccgaatcgctcacaatgaagctctcagaatcaaatgtgcatacattgtttgtcagcttattaaaggatatgggcataatactcgcaccgattttgcttgttgctcttgttgcaggagtcgtaagcaactatatgcaggttgggttcttattttctgctgaagtgatacagcctaagcttgaaaaactggatccgatcaaaggctttaaacgaatatacagtatgagggcgattgtagagctgattaaatcaattttgaaaatcgtagtcgtcggttttgcggcttttgctgtgctttggctgcattatggagaaattctccggcttcctctcctgacacccgaagaggcactatctttcgtttcaaagctcactttgtggatgggactgagcggtgcaggcgctttattaattcttgctggtcttgactatttatatcagagatttgattatgagaaaaatatcaaaatgtcaaaacaagatataaaagatgagtacaaaaaatctgaaggtgacccgattattaagtctaaaattaaacaaagacagcgggaaatggcgatgaggcggatgatgcaggaagttccaaaagcagatgtcattatcacaaacccgactcactatgcgattgctttgaaatatgatgaagaaaaaatggacgctccttatattgttgcaaaaggtgtcgaccacctggcgttaaaaatcaggaaaattgctaaagagcatgatgtcatgatggtagaaaacagaccgcttgcccgtgcgttatatgatcaggtggaaattgaccaggcagtgccggaagaattttttaaagttttagcagaaattctggcttacgtatataaaacaaaacaaaaagtatattgaatttttcgatttaaaaggagagaaaaaacagcatgtcaacaagagatttatccgttttaataagtgttgtcctcattgtggcgatgctggtgattccatttcctccatggctgttaagtattttgatcattattaatatttctcttgcgttgatcgtgcttctcaccacaatgaatatgcaggaagcgcttcagttttcgatttttccgtcactgttgctgcttttgaccctatttcgtttgggcttgaacgtctcaactacccgttcaattctttcacacggtgaaggagggaaagtcgtcgagactttcggaaatttcgttgtcggcggaaatgtattagttggactcgttgtatttatcatccttattattattcagtttatcgtcattacaaaaggtgctgaacgtgtttccgaggttgcagcaaggtttacgctggacgcaatgcctgggaagcagatgagtattgatgctgatttaaacgcagggatgattaccgaacaggaagcgaagcatcgccgcgaaaaagtggcaagagaagcagacttttatggagcaatggacggtgccagtaaatttgtgaaaggtgacgccattgccggaatcatcattgtgatgatcaatattattttcggaatcgtgatcggaatgcttcagcagggcatgtccattcaagaggctgcttcacactttacgatgttgactgtaggggatggaattgtttcgcaaatcccggcactgttaatttctacggctacgggtattgtggtcacaagagctgcatctgaaggaaacttagggcatgacattacaggccagctgtttgcgtatccaaagcttttatacgtcgcagcagctacgatcatgcttttaggtattttcactccgatcggcatccttctgacggggccgcttgcgggattgcttgcttttggcgcatatacactatctaaatcaggtaaggaaaaagaagaagtggatgagattcttgaggaagaggctgaggtggacgagcttaaaagccctgaaagtgttgttcagcttctgcatatagatccgatagaatttgagtttggatatggcctgataccgcttgctgatgccaatcaaggcggtgatttattagaccgaattgttatgatacgccgtcagttggctttggaactcgggcttgtcattcctgtcgtgcgaatcagagataatatagcgttgcagcctaatgaataccgattgaaaattaaaggaaacgaagtagcaaaaggcgagctgttgcttgatcattatttagcgatgtcgcctactcctgaggacgatctcattgaagggattgaaacagtggagccttcattcgggctgccggctaaatggattagcgaagcggtaaaggatgaagccgacatgcttggttatacagtagttgatcctgcatcagtcgtttcaacgcatattacggagaaaattaagcagcatgcccacgaattgatcggaaggcaggagacaaaacagctgatcgatcacttgaaagaatcgtatccagtcttagttgaagaggttacgccgaatccattgtctgtcggtgatattcagaaagtgcttgctaagcttttaaaagaaaaagtttcaattcgaaacttagtaacgatttttgaaacacttgctgactatgggaaattaacaacagattctgatctcttgacagagtatacaagacaagcgcttgctaaacaaattacagcccagtttgccaaagaaaatgaagtgttgaaggttgttacttgttccggccgtgtagaaaaagcaatagcagacggtgtgcagcagacggaacacgggaactatttatcacttgaaccagatatttcagaaagtatagtgcgctctgtcgctaaagaagctgaacagctctcattacgtcaggaaaccgcgattcttctttgctcgccgcctgtcagaatgtatgtgaagcagcttctggaacgatacttccctgatcttccggtactctcttataacgaacttgaggcgaatgttgaggtacaaagcattggagtggtggatatttaatgaaaataaaaaaatttactgctgcttcaatgcaagaagcggcacttctcatcagaaaagagttaggtaatgaagcggtcatattaaattcgaaaaaaattaaaaagcgaaaatggtttggcctcatcaacaagcctgctgttgaagtaatcgccgtattggatcaggactttcttgagaaaaaaacgcctcagaaggcagctgaaccgaaacaaacattaaaaactccggtcagcagtccgaaaatagaggagagaacatatccccctcaaattccggcgcaacaggagctaggtgatttttcagcatatcaatctgtacttcctgagccgctgcgaaaagcagaaaagcttttgcaagaaacagggatcaaagagtctatgaaaacgaacactctgaaaaaattgcttcgcttctctgttgaagcagtcggcttgactgaagaaaatgttgtcggcaaacttcaggaaatactatgcgatatgctgccctcagcagacaagtggcaggagccaattcattcaaaatatatcgttctctttggttcaacaggggctggtaaaacaactacactggctaaactcgcagccatatctatgcttgaaaaacataaaaaaatcgcttttattacaacagatacgtatcgtattgcagctgttgaacagttgaaaacatacgctgaactgctgcaggctcctctggaagtttgctatacaaaagaagaatttcagcaggcgaaggagttattttctgagtatgatcatgtgtttgttgatacagccggaagaaacttcaaggacccgcaatacattgatgaactgaaagaaacgattccttttgagagcagcattcagtcatttcttgttttatccgcgactgcaaaatatgaagatatgaagcatattgtcaaacggttttcatccgtccctgtcaatcagtatatttttacgaaaatagatgaaacgacttccttaggttctgtatttaatatactggcagaatcaaaaataggtgtcgggtttatgacaaacggacagaatgtgcctgaggatatacagactgtatctccacttggttttgtgaggatgctgtgcagatgaacagatatgaccaagcagcaactttacgggcgaaaatggaaaaacgtgagcgcgttctgccgatggtttattcacaaaaagcgaagacacttgctgtcattagcggcaagggcggtgttggaaaatccaatattaccttaaatatggcacttgcgctgcaggataaaggtaggaaggtgctgctcatcgaccttgatatcgggatgggaaatattgatatattaatggggaattcatcgtctgccacgataatcgatgttttaaccgaccgtaagcctttgctgcagtcattatccgttggcccaaagggtttgcggtatatatcagggggaactggtctggatgtgatgttccagctcgatcagagaaaatggacgttttttgccaatgaactttctcatgcattaagccagttcgattatgtgctgtttgatatgggagcgggcttatcaaaagatcaactgccttttattttatcagcagaagatattttgattataacaactcccgagccgacggccattatggacgcatacagcgctgtcaagcacttggttttgacagaaaataagctttcaatgaaggtggctgtcaatcggtgccgtgaccaaaaggaagggcttgacgcttttgcccgcctctcccgtacaattcatatgtttttggatgttcaggttcagtttgccggttccgtttctgacgatgtgatcgtgagcaaagcggttgtcgaacaggttccttttttcataaaaagccctcaggcaaaagccagccggtcagtccgtattttagcggacgccttgtttgaaagagaagaaacgagacacaaagaagacaaacagacatttattgagaaattatcttcttttttaatgaggagggcttaatttgattcgtgtgcttgtagttgatgattcagcttttatgagaaaaatgataagtgattttctgaccgaggaaaagcagatagaagtaatcggaactgcgagaaacggagaagaagcgcttaagaagattgaattattaaaaccggatgttattactcttgatgttgaaatgccggtcatgaatgggacagatacgctccgcaaaattattgagatttataacttgccggtcattatggtgtctagccagaccgagaaaggtaaagaatgcacaattaattgtttggagatcggtgcctttgactttatcacaaagccatcaggctcaatatctctggatctatacaaaattaaagaacaattagttgagcgtgtcgtcgcggcaggactttccggcaagcggaaacgtcctgtttcccagacagttcggcccgaacctattgtgcgtgctgtcgttaagcctgaattaagcaaaccgaaacctggcacgggcagacaaattgtgtgtatcggcacatcaacaggcggtccacgggcgttacaaaaggtgataccgaagctccctaaggatttgaacgcaccagtggttgtcgttcagcacatgcctgaagggtttactgcttctttggctgatcggctgaatcatttatctgacattcaggtaaaagaagcaaaagatggtgaagcagctcttaacggctgtgtttacatagcaccgggcggaaaaaacatatctgttattaaaaacagcgaaggactccaggttgtgcttgataaccatgacacaccaagccgtcataaaccatctgctgattatttattccgttctgtcgggaaactgacagattatgaaaaagtagcggttatcatgaccggaatgggcagtgacggcactgctgggctaaaggacatgctaacagccggcaatgtgaaagccattgcggagtctgaagaatcttgtgtcgtatacgggatgccaaaagctgctgttaaagcgggtctcattcatgagattaaacatgtggaagatatcgcagcatccatcacaagctgtgtgaaaaaagagagggtgtgattcaaatggatatgaatcagtatttagatgtctttattgatgagagtaaagaacatttacaaacatgtaatgaaaagcttcttcttttagagaaagacccgactgatcttcagctcgtacatgatatattcagggctgcccatacattaaaaggaatgagcgcaacgatgggctacacggatttagcacatcttacccatctgcttgaaaacgtgctggatgcaatccgaaacggagacatggaagtcacctcagactggctggatattttgtttgaagctctggatcacctggaagcaatggttcagtctattattgatggcggggatggtaaaagagatatctcagaagtgagtgccaagcttgatgtgaatggtgcgcacgctgaatccgctgcctccgctgaacctgcagaagcacagagttcagcatctgattgggaatatgatgaatttgaacgcacagttatacaagaagcggaggagcaaggcttcaaacgatatgaaatcaagatttctctgaacgaaaactgtatgttaaaagcagttcgtgtctatatggtgtttgaaaaactaaatgaagtcggagaagtagccaaaacaattccaagtgctgaagtgcttgaaacagaagattttggaactgactttcaagtttgtttcttaacacatcaatcagcggaagacattgaacaattaatcaatggcgtgtcggaaattgagcatgttgaagtcattcaaggggctcctttaacatcagctgaaaagcctgaagaatctaagcaagaagattcaccagcagcagctgtacctgcgaagcaggagaaacaaaaacagcctgctaaaaacgatgaacaggcgaagcattcagccggcggatctaaaacaattcgtgtcaacattgacaggcttgattctttaatgaacttatttgaagagcttgtcattgaccgcgggcggctcgagcagattgcgaaagagcttgagcacaatgaactgactgaaacggttgaacgaatgacgagaatttccggagatttgcaatcgattattctgaatatgagaatggtcccggttgaaaccgtttttaacagattcccaagaatgattcgccagcttcagaaagagctgaataaaaaaattgaactctcgatcatcggtgcggaaactgaactggatcgtacagtaattgatgaaatcggagatccactcgttcacttgatcagaaacagtattgaccatggtatcgaggcgccggaaacacgtttgcaaaagggaaaaccggaatcaggaaaagttgtgcttaaagcttatcacagcggcaaccatgtctttatcgaagtagaggatgacggcgcaggccttaatcgcaaaaaaattctggaaaaagcgcttgagcgcggggtcataacggaaaaagaagctgaaaccttagaagacaaccaaatttacgaattgatttttgctccggggttctcaactgctgaccaaatttctgatatttccggccgcggtgtaggacttgacgttgtaaaaaacaaactggagtctcttggcggttcagtcagtgtgaaatcagccgagggtcaaggctctctattcagcatccagctgccgcttaccttgtctattatttcagttctgctgattaagttggaagaagagacatttgccattccgatttcttcaatcattgagacagcagttattgacagaaaagacattttgcaaacgcatgaccgtgaagtgattgactttagagggcatattgtccctgtcgtttatttaaaagaagagtttaaaatagaagatacaagaaaagatgcggaacagctccatatcattgtcgtgaaaaaaggcgacaaacctactgcatttgtggtggactcctttattggccagcaggaagttgtgctgaaatcactcggagattatttaacaaacgtctttgcaatttccggagctactattttaggagacggagaagtagcgctcattattgattgtaatgcactgattatttaaccattcgaggaggtgtctcacatgactgcagaaattaaaacaggcgaaaaaatgatagtctttatggtaaatggcaaagaatatgccatttccgtcactcaggtgaaatcaattgaaaaatggcaaaagccaacgagggtacctggcgtcgaaccatatatttgcggggtaatcaatttacgcggggtggtgactccggttattgatttaagaaaacgcctgaatttgccagagtatgaaattaccgatgaaacacgaattatcattattgcttatcgtgatattgaagtcggctggattgtggatgaagcgaacgatgtgattaccgtacacgaaagtgaaatagaatctgctccagaaggcgttcagaaagatacggatgtgtcgatcgaacagattgtgaaacaagagaacagactcttaaatattattgatgcgaacgcggttttggataaagaatcatctcagtccgctgtgcccgatcaagcttaatcttaaaggggttatgacatgagtatttttaatggaatcaaagaagagcagatggacattttgcgggaagtcggcaatataggcgccggccactccgcctctgcaatggcccagctgttaaatagaaagatagatatggaagtcccatttgcaaagctgctgtcttttgatgagcttgttgattttttcggcggcgccgatgtcccggttgccagcatctttttaagaatggaaggcgatttaacgggttcaatgttctttataatgcctttttttcaggcggagcagtttatcagagagctgattggaaaccccgattttgacatagaggacttaggtgaagaccacatgagctcatccgctttgcatgaactgggcaatattttagcggggtcatatttaacagctttggcggatttgacgaaactccaactctatccaagtgttcctgaagtctcattggacatgttcggagctgtgatcagcgaagggctgatggagctcagtcaggttggagaacacgccattgttgtcgacacgtcaatttttgaccaaagccatcagcaggagctgaaagcgcatatgtttatgctgccggactatgattcatttgaaaagctctttgtcgctttaggtgcatcattatgagtacaactgaggctgttgttataaaggttgggattgctgacgtgaagatcgcccgcttcccggataccatccggacctctggtttgggctcatgtgtggggctggtgctttatgataaagaaaagcaaacggcgggtcttgttcatgtcatgcttccggattcgacgttatcgaaaactgccgagctcaaccgggctaagtacgctgacaccgccgtacagaccacgattgatatgctgatagaagcgggatgccggaaatttgcattaaaagcaaagctggccggcggatcagagatgtttaaatttaaatcgacaaatgatttgatgaagatcggaccgagaaatgtattagcgataaaagaacagctgtctttatttaatattcctattattagtgaagatacgggcggctcaagcggccggacaatagaatttgaaccgaagtcctgcatgctgcatattcgaactgttaaacaaggtgaaaaaacgatttaattaaggtattagggggataacaatgcaatccttgaattatgaagatcaggtgctttggacgcgctggaaagagtggaaagatcctaaagccggtgacgacttaatgcgccgttacatgccgcttgtcacatatcatgtaggcagaatttctgtcggactgccgaaatcagtgcataaagacgatcttatgagccttggtatgcttggtttatatgatgcccttgaaaaatttgaccccagccgggacttaaaatttgatacctacgcctcgtttagaattcgcggcgcaatcatagacgggcttcgcaaagaagattggctgcccagaacctcgcgcgaaaaaacaaaaaaggttgaagcagcaattgaaaagcttgaacagcggtatcttcgcaatgtatcgcccgcggaaattgcagaggaactcggaatgacggtacaggatgtcgtgtcaacaatgaatgaaggtttttttgcaaatctgctgtcaattgatgaaaagctccatgatcaagatgacggggaaaacattcaagtcatgatcagagatgacaaaaatgttccgcctgaagaaaagattatgaaggatgaactggttgcacagcttgcggaaaaaattcacgaactctctgaaaaagaacagctggttgtcagtttgttctacaaagaggagttgacactgacagaaatcggacaagtattaaatctttctacgtcccgcatatctcagatccattcaaaggcattatttaaattaaagaatctgctggaaaaagtgatacaataatgaatttcatggttagcgagtgaaaaacatgtcaacactattatggcttttaagctttacgctccacggcgttcttctgtacgctgtcattattctgtatacgaggctcgctgcagtgaaagaaacagaaaaacagcaaaaacagatacttgaagagacggaaaacaccttggcggcatttctgcttgaattaaaagaagaaaatgagaaactgatagaaaataaagcttcatttgcaagtcaatcagatgaagaatcccaaaagccaggccttcagacctctgaaacatatcaagagcgggatccagtccaagaggcagagaatcttcctgaacatattgaaggtctgattacagaggttgaccgtcgggaagagatcgtaaacagtgaggtccaatcatttgaagaccaggtcatagaattatatgaacagggatattcggcaagtcaaattgcccagaaaatgaagagcggaaagacagaaatcgagctatttttaaaatttcgctccaaaggtgtaaaggattcttgattgtcggataaagctgtgttatattatgtcttggtgttaaatacacacgcttaacgatttatgcagagggtgctgcaggcggcagttctgcacaaaaatgacctaagcggaggaaaaaaaccattatattaggaggaaataacatgtcagtcatttctatgaagcaattgcttgaagctggtgttcacttcggtcaccaaacacgccgttggaacccaaaaatgaagcgttacattttcacggagcgtaacggaatctacatcattgaccttcaaaaaacagtcaaaaaagtagaggaagcttacaacttcactaaaaatcttgctgctgaaggcggaaaaatccttttcgtcggaacaaaaaaacaagctcaagattctgttaaagaagaagctcaacgctctggcatgtactatgtcaaccaacgctggttgggcggtacattaacaaactttgaaacaatccaaaaacgtattaaacgtcttaaagacattgaaaaaatgcaagaaaacggtacgtttgatgtacttcctaaaaaagaagtcgttcaattgaaaaaagaattagagcgtcttgaaaaattcctaggcggaattaaagatatgaaggatcttcctgatgcattattcatcatcgatcctcgcaaagagcgcatcgctgttgcggaagctcgcaaattaaacatccctatcatcggtatcgtagatactaactgtgatccagatgaaatcgatgttgttatcccagcgaacgatgacgctatccgcgctgttaaacttctaacttctaaaatggcagatgcaatcttagaagcgaagcaaggcgaagaagaagcggaagttgctgaagaaactgcaccagaaacagaaacaacaactgcgtaacctattcaaaaggtgataagagggactgccttttatcaccttttttcaagaaaaatgtgtaatatacatactcttgtttaaacatataaggaggaatacaaatggcaattactgcacagcaagtaaaagaactgcgtgaaaaaactggcgcgggcatgatggattgtaaaaaagcgttaactgaaactgacggagatatggacaaagcaattgatcttttaagagaaaaagggattgcaaaagcagcgaaaaaagctgaccgtatcgcagcagaaggttctactcttattaaaactgacggcaacaaaggcgttatcctagaagtaaactctgaaactgatttcgttgcgaaaaacgaaggttttaaagagcttcttaacactttagctgaccaccttcttgcaaacacgccagctgatgttgaagaagcaatgggccaaaaaatggaaaatggctcaactgttgaagagtacatcacaagcgcagttgctaaaatcggtgagaaaatcactcttcgccgctttacagttcttacaaaagacgacagctctgcattcggtgcgtaccttcacatgggcggccgcatcggtgtattaactgttctcaacggtacaactgatgaagaaactgcgaaagatatcgcaatgcacgttgctgcagttaaccctcgttacatttctcgtgatcaagtatctgaagaagaaacaaatcatgagcgtcaaatcttaactcagcaagccctccaagaaggcaaacctgaaaacatcgtagcgaaaatggttgaaggccgtctgaacaaattcttcgaagaaatttgtctattagaccaagcgttcgttaaaaacccagatgaaaaagtgaaacaagttattgcagcgaaaaacgctactgttcaaacttttgtccgctatgaagttggagaaggcatcgaaaaacgtcaagaaaactttgctgaagaagtaatgaaccaagtgaaaaaataatggtgaaaagatttcgcggctaagtcgcgtcttttcaggcagtataggggacacattttgtgttccctatttttaaaactatatttacaaacctttttttctcttgcataatagaaaacggcaatgtttacacttggaggttatcatggaaaaaccaaaatacaaacgtatcgtattaaagcttagcggggaagcattggcaggagaacagggaaatggaattaacccgactgtcattcaatccattgcaaagcaagtgaaggaaatcgctgagcttgaagtcgaagtggctgttgtagtaggcggcggcaacttatggcgcggaaaaacaggaagtgacctgggcatggaccgcgcgactgctgactatatgggaatgctggcgacagtaatgaattcgcttgctcttcaagacagcttggaaacactcggaatccagtccagagtgcaaacatccattgaaatgagacaagttgctgaaccgtacataagaagaaaagcgatacgccacttagagaaaaaacgtgtcgttattttcgctgcgggtacaggaaacccatatttctcaactgatacgacagctgcactgcgggctgctgaaattgaggcagacgttattttaatggctaaaaataacgttgacggtgtgtataatgctgatcctagaaaagatgaatcagctgttaagtatgaatcactttcttatcttgacgttcttaaagacggcctggaagtcatggattcaacagcttcctctttatgcatggacaatgacattccgcttatcgtcttttctattatggaagaaggaaatatcaaacgtgccgttatcggtgaatcaatcggaacgatcgtgagggggaaataacgtgtcaaaagaagtattaactcaaacaaaagaaaaaatggaaaaagcaattgctgcttatcagcgcgaattggctactgtacgcgcaggccgtgcaaatccatcattattagataaagtaacggttgaatattacggagcgcagacacctttaaatcagttgtcttctattaacgtgcctgaagctcgtatgctcgttatcacaccatacgacaaaacagcaattggcgatatcgaaaaagcgattttaaaagctgatttaggtcttacaccaacaagtgacggcaatatgattcgaattgcaattccggcactaacagaagagagacggaaagaattagtgaaagttgtaaaaaaatacgctgaagaagcaaaagtcgctgttcgtaacgttcgccgtgatgctaacgatgatctcaaaaaacttgagaaaaacggagacattactgaggatgaactgcgtgcttccactgaagacgttcaaaaactgacagatgaatatgtgtcaaaaattgacagtgtcacaaaagacaaagaaaaagaaatcatggaagtttaatgaaaaactatgtacaatagataatagtgaaaagaccctctcatgtttacagggggtttttttgttaatactgttgattacattgattatcagcagggaatgtaacctttttgggtgacggaggaatctcatgctcaacatactcaaaaattggaagaatcagcaaacagcggcttccaacttagaacgttatacaaaagaagacatacttaagggagaaattcccgaacacatcgccattatcatggatggaaatggccgttgggctaaaaaacgctctcttcccagaattgcaggccaccatgaagggatgaaggtggtaaaaaggaccacgaagctcgcaaacgaattaggtgtcaaagtactgacattgtatgcattttcaacagaaaactggaaaagaccgaaaatggaagtcgattttttaatgaagctaccggaagaatttttgaatacgtatcttccagagcttgttgaggaaaatgtacaggttcggatcattggggatgaaacggctttgcccgcgcacacattacgtgcgattgaaaaagctgtacaggacacggcgcaaaacgacggaatgatccttaattttgctcttaactatggtggccgtactgaaattgtcagtgctgcaaaatcactcgcggaaaaagtgaaggaaggctctttgaatattgaagacattgatgaatcgcttttttctacttatttgatgactgaatctttgcaggatcctgaacttttaattcgaacgagcggcgagataaggctgagtaattttatgctatggcaggttgcctacagtgaatttgtctttactgacgtcttgtggcctgactttaaagaagatcacttcttgcaggcgttaggagagtttcagcagagaggccggaggtttggcggaatttagaggatggtggacatgaaacaaagaattttgacaggtgttctggcagcaattgtatttttatttttggttattgtcgggaaattgccgttcaccatattaatttatgctatgggcagtgtggcgctttttgaacttttacggatgaaaaagctgaagctggtttcactgccgggtttgatcggtcttttattattgtggatgttcttattgccaagccagtattcgttttttgaagcggacggaatttccaaaatggaaatcgctttatttgcggtactgctattgctgacttacacagtgttggtcaagaacacctttacttttgatgaagtcgggtttattacgcttgcagcaatttacatcggaatgtgttttcattattttatcgaaatcagaaatcttgaccaatacggattaacatacattttttatgcgtgtgttgtcatttggtccaccgattccggtgcctattttgtcggtaaatcgcttgggaagcggaaactgtggcctgaaatcagtccgaataaaacagtggaagggtttgcaggcggaattgtcatcgcacttgtattggcgacgatttttcagcttgttgcacaacttccgatcccgtatatctatctgctgttgatcacgctgtttttgtctgttttcggacaacttggagatttagtggaatccgccttgaaaagacattacgatgtaaaggattctgggaatattcttcctgggcatggcggtatattagaccgttttgacagtttcttgtttgtcatgcctttcttgtactttctgcttgcccttttttcataaaaaagtctaatatgaatatgagactgatcatgcagcaataagaataggagtagtggcaactttgaaaaatatttgtcttttaggagcaacaggatcaatcggcgaacagactcttgatgtactgcgtgcacatcaagatcaatttcagctggtatctatgtcgtttggcagaaatattgataaggccgttccaatgattgaggtctttcagccgaagtttgtctctgtcggtgatctggatacatatcataaattaaaacaaatgtctttttcttttgaatgccaaatcgggctgggagaagaaggactgatagaagcagcagtgatggaggaggttgacattgttgtcaacgctttgcttggaagcgtcggtcttatcccgacgttaaaggcaattgaacagaaaaaaacaattgcgcttgcaaataaggaaactcttgtcactgcagggcatatagtaaaagaacatgctaagaaatatgatgttccgctgctgcctgttgacagtgagcattcagccatttttcaagctcttcaaggcgaacaggctaaaaacattgaacgcctcatcattacggcatccggcggaagttttcgggacaagacgcgggaggagctcgaatcagtaacggttgaagatgcattaaaacatccaaactggtcaatgggtgcaaaaattacaattgattcggctacaatgatgaataagggattagaggtgatcgaggcacactggcttttcgatataccttatgaacaaattgatgtggttttacataaggagagcatcatccattcaatggttgagttccatgataaaagtgtgatcgcacagctcggaactccggatatgagagtccccattcaatatgcgctcacttatcctgaccgattgccattaccagatgcgaaaaggcttgaattatgggaaatcggcagccttcattttgagaaagctgattttgacaggttccgatgcttacaatttgcttttgaatcaggtaaaataggaggaacaatgccgacagtgctaaatgcggcaaacgaagtagctgtcgctgcctttttagctggcaagataccgtttttggctattgaagactgtatcgaaaaggcactaacccgccatcaattactgaaaaaaccgagcctggcggacattcaagaagtggacaaagatacccggggatacgtcaattcaatactcacataaggtggtatgttcgtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcggatttgttcgtatggccggcgaagatccggaaatgattgaggtgaaacccggatacacggtcgggcttctgtttaataaggaagatcaagttgagaaagtcatcatcaatcaaaaggaaaaatatccggatgctttagtcattgaagtggaaacagcggatttagagcatgacatgaagatcaccggttatgaacaggggaaagaggacgaactttccagctttactgtcagcgaaacatccttttttattgtagacggagaagaagtgcagattgcgccgtataatcgccaatttggttccaaacctgtgtggcagcggattaaagcaattgctgcagggccgattatgaactttattttagcttacgtcattttagtgatgcttgggctgattcaaggcgtaccgtcaaatgaacctatgctcgggcagctgacagacaatggacgggcagctgaagcagggctaaaagaaggggattatatccaaagcattaacggagagaaaatgaggtcttggactgacattgtctccgctgtaaaagaaaacccggagaaagaaatggacgttgcagtaaaaagagataacaaaacgcttcatatttcggtgactccggaagctgttaaagatgagaacaaaaaaacaatcggccgtttcggttcctatgcgccgactgaaaaaggcgtactctcagcggttgcttacggcgcgacatcaacagttgacattggcaatcaaatcttagaaacgtttggtaatttagtaacaggacaatttaaaataaatatgttggcgggaccagttggtatttatgatatgacagaccaagtggcgaaaaccgggttagttaatttggttcgtttcgctgcgtttttaagcattaatcttgggattgtcaacctgcttccgattccggcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaaacgaaaagtaaatcaatcagaggtgcgaagaaatgagacaaagcttgacgcttattcctacgctccgtgaagttccagctgatgccgaagcaaaaagtcatcagcttcttctgagagcaggatttatcagacagaatacgagcggggtatacagctatatgcctcttgcgtataaggtgattcaaaacattcagcagattgttcgagaagaaatggagaaaattgatgccgtagaaatgctcatgcctgcgttgcagcaggcagagacatggcaggaatcaggcagatggtatacgtatggtcccgaactgatgagactaaaagaccgtcatggccgtgaatttgctttaggggcaacgcatgaagaggttatcacttcgcttgttcgcgatgaggttaaatcttataagcgtctccctctgactctttatcaaattcagtctaagttcagagatgaaaaacgtccgcgcttcggtttgttaagaggccgcgaatttattatgaaggatgcgtactctttccatgcatctgcagagagcctggatgaaacgtatcaaaaaatgtacgaggcctattctaatatttttgcccgctgcggcattaatgtaagacctgttatcgctgattcaggcgcaatgggaggaaaggatacgcacgaatttatggcactttctgcgatcggagaggatacgattgcgtattctgatgaatcacagtacgcggctaatatcgagatggctgaagttcttcaccaggaagttccttcagatgaagagcctaaagctctagagaaggttcatacgcctaacgtgaaaacaatcgaagaactgactgcgttcttacaggtttcggctgaagcgtgcattaagtcagtattgtttaaagctgatgaccgttttgtcttagtgcttgtaagaggggatcatgaagttaacgatattaaagtgaaaaacttgcttcatgcagaagttgtagagcttgctacacatgaagaggtcattcagcagctcggaacagagccaggttttgtaggccctgttggtattcatcaggatgtggaagtatatgccgatcaagctgtgaaagcaatggttaatgctgttgccggggcaaatgaaggagatcatcattataaaaatgtcaatgtgaatcgtgacgcgcaaattaaagaatttgctgatcttcgttttattaaagaaggtgatccttcaccagacggcaagggaacgatccgttttgctgagggaatcgaagtcggacaagtctttaagctcggaacacgctattcagaagcgatgaatgcgacatatttagatgaaaacggacgcgcgcagccaatgctgatgggctgttacggaatcggtgtgtcaagaacgctttctgctattgctgaacagcatcacgacgaaaaaggattaatatggccaaaaagcgttgccccgtacgatcttcatattcttgcattgaacatgaaaaacgatgggcaaagagagcttgctgaaaagctgtatgccgatttaaaagcggaaggctatgaagtgctctatgacgaccgtgctgagcgtgccggtgtaaaattcgctgattcagatctaatcggccttccaatccgcatcactgtcggaaaacgggctgacgaaggaatcgtcgaagtgaaaattcgtcaaactggtgagtcaactgagatttcagtagacgaattatctgcgtttatcagcaagcagtaatcaccataacgatttatcaaaaaacatgttaaaatagaaataatagaaggtacctcattgcctgaggtaccttcacttatgatgtttttagggagggatactgtcttaatggaacagttatcagtaaacagaaggcagtttcaaattcttctgcagcagattaatatgacagatgataccttcatgacatactttgaacatggcgagattaaaaagctgacaattcacaaagcttctaaatcttggcattttcattttcaatttaaatctttgctgccttttcaaatatatgacacattaacaacgaggctgacgcaatcgtttgcccacatagcaaaagtgacatcttcaattgaagttcaggatgccgaggtcagtgaaagtatcgttcaagactactggtcacgctgcattgaagaactgcagggcatttcgccgccgatcatcagtcttttaaaccagcaaaaaccgaagctgaagggcaataaactgattgtcaaaaccaaaacggatacagaagcggctgcgctaaagaacaaatacagttccatgatacaagcaggctaccgtcaatttggctttccagatcttcagcttgatgctgaaatatttgtatccgagcaggaagttcaaaagtttcgggaacaaaagcttgcggaagaccaagagcgggcgatgcaggccttgattgaaatggagaagaaagataaagaaagtgatgaagaccaagcaccatctggtcctcttgttatcggttatcaaattaaagataacgaggaaatccggacacttgacagcatcatggacgaagaacggagaattacggtccaaggttatgtgtttgatgtggagacgcgcgagctgaagagcgggcgcacgctgtgtatcttcaaaattacagactatacaaatagtattttgatcaaaatgtttgcacgtgaaaaagaagatgcggcactgatgaagtctctgaaaaaaggaatgtgggtaaaagcacgcggaagcattcaaaatgatacatttgtcagagaccttgtcatgatcgcaaatgacgtaaacgaaataaaagcaaaaacccgtgaagattcagcacctgaaggagaaaaaagagtggaattgcatcttcattccccaatgagccaaatggatgctgttacgggtatcggaaagcttgtcgaacaggcgaaaaaatgggggcatgaggccatcgctttgactgaccatgctgtcgttcaatccttccctgatgcgtattctgcggcaaaaaagcatggaattaaaatgatttacgggatggaagcgaatctcgtggatgatggcgtgccaattgcttataatgccgcacatcgtctgctcgaagaagaaacatatgttgtttttgacgttgagacgacaggattgtctgctgtatacgataccattattgaactggctgcagtaaaagtaaaaggcggagaaattattgataaatttgaggcgtttgcgaacccgcatcgtccgctttccgccacaatcatagagctgacagggatcactgatgatatgctacaagacgctccggatgtcgtagatgtaataagagatttcagagaatggattggcgatgatatccttgtcgctcataatgcaagctttgatatgggattcttaaatgtagcctataaaaagcttcttgaagtcgataaagctaaaaacccagtcattgatacgcttgaacttggacgttttctctatccggaatttaagaaccaccggttgaacacactttgtaaaaagtttgatatcgaactcacacagcatcaccgtgcgatctatgatactgaggcaaccgcttatttgcttctgaaaatgctgaaagacgcagctgaaaaaggcattcagtaccatgatgagttgaatgaaaatatgggtcagtccaatgcttatcaaagatcaagaccgtatcatgcaacattacttgccgtgaacagcacgggacttaaaaatttatttaagcttgtgtcactttctcatattcattatttttacagagtgccgcgtattccgagatctcagcttgagaaatacagggaagggcttctgatcggttctgcctgtgacaggggagaggtttttgagggaatgatgcaaaaatcgcctgaagaggtggaagatattgcgtcattctatgattaccttgaggttcagccgcctgaagtgtatcgtcacttgctggagcttgaactggtccgtgatgaaaaagcgctgaaagaaattattgcgaatatcacgaagctgggggaaaagcttaataaaccggttgttgctacgggaaatgttcattatttgaatgatgaggataaaatctacagaaagattttaatatcctcacaaggcggggcaaatccgctgaataggcatgaactgccgaaagtgcatttcagaacgacagacgaaatgcttgaagctttttctttcttaggtgaagaaaaagcgaaggagatcgtagtcaccaatacccaaaaggttgcttctttagttgatgacatcaagccgattaaagatgatttatatacgccgaaaatcgaaggcgctgatgaagagatcagagaaatgagctatcagcgtgcaagaagcatttacggggaagagctgcctgaaattgtcgaagcgcggattgaaaaagagttaaagagtattattggccacggatttgctgttatttacttgatctctcacaaacttgtaaaacgttcactagatgacgggtatctcgttggttcccgtggttccgtaggatcttcattagttgcgacacttactgagattactgaggtaaacccgctgccgccgcactatgtttgtcctgagtgccagcattctgagttctttaatgacggttctgtcggttctggttttgacctgcctgacaagacatgccctcattgcggaacgcctttgaaaaaagacggccatgatattccatttgaaacgttcttaggatttaaaggggacaaagtacctgatatcgatttgaacttctcaggggaatatcagccgcaagcacacaattacacaaaagtattgttcggagaagacaatgtatatcgtgcgggaacaataggcacggtggcagaaaaaacagcctacggttatgtaaaaggctatgccggagacaacaatcttcatatgcgcggtgccgaaatagatcggctcgtacagggatgcacaggtgtaaaacgtacaactggacagcaccctggcggtattatcgtagttccggattatatggatatttatgatttttcaccgatccagttcccggcagatgccacaggttcagagtggaaaacgactcattttgatttccactccatccatgacaacctgttaaaacttgatattctcggacacgatgacccgactgttattcggatgcttcaagacttaagcggaatagatccgaaaacaattccgacggatgatcctgaagtgatgaagatcttccagggaaccgaatcactcggtgtgactgaagaacagattggctgtaaaacgggcactcttggaattcctgaattcggaacccgatttgtccggcagatgcttgaagatacaaagccgaccactttttctgagctcgttcagatttcaggcttgtctcacggaactgatgtatggcttggcaatgcacaggagctcatccacaataatatttgtgagctgagtgaggttatcggctgccgtgatgacattatggtttatttaatctatcaaggccttgagccgtcccttgcctttaaaatcatggaattcgtgcgtaaaggaaaaggattaacgcctgaatgggaagaagaaatgaaaaataacaatgtcccagactggtatattgattcctgtaaaaagattaaatacatgttcccgaaagcccacgccgcggcatatgtcttaatggcagtccgcattgcttactttaaagtgcatcatgctcttttgtattatgcggcttattttaccgttcgtgcagatgactttgatattgatacaatgatcaagggctctacagcaatcagagcggtaatggaggatataaactctaaaggacttgatgcttcaccgaaggaaaagaaccttctgactgttttagaattagcgcttgagatgtgtgagagaggctattcattccaaaaagtcgatttatatcgctccagcgccacagagtttattattgacggcaacagtctaattccgccgtttaactctatccctgggttagggacgaacgctgctttgaacattgtaaaagctcgcgaagaaggcgaattcctctcaaaagaagatttgcaaaagagagggaaagtatcaaaaacgattttagagtacttagatcgccatggctgtctggagtcactgcctgatcaaaaccaattgtcactgttctaatatggaaagcagaatttctcagaaattctgcttctatgcatacataagcgcaaaaagtgccatcgtaatattagagtttctgtcacttgcttaggtatgaaggtaagcgtatatccatttgcaataaaaatatggttatggtatagttttattggaaatgctaacgattaccgaggcaaagagtggggaaacccgctcttttgtattgaacaggagaattttgtctcgacatgttcatcgtttactttttagcccctgctcttttgaagcagggtttttatgcagagtgacgagacgaatatgagatcgacagcacaaggaggaagaacatgagcaaaaaagtgactgacaccgttcaagaaatggctcagccaatcgtagacagccttcagctggaactcgttgacattgaatttgtcaaagagggccaaagctggttccttcgcgtgtttattgattccgatgacggtgtggatattgaggaatgtgccaaagtaagcgaagctttaagcgaaaagcttgatgaggcagacccaatcagccaaaattactttcttgaagtctcatctccaggagctgagcgtccgctaaagaaaaaagccgatttcgaaaaatcactaggaaaaaacgtatacattaagacgtatgagcctattgacggcgtaaaagtgtttgaaggtgaactggctgaatttgatggacaaacagtgacagttgagatcacgatcaaaacaagaaagaaacggatcaatattccgtatgaaaagatagctaatgcaagattagctgttacattctaatgaatacaaatgttttaaggggggagaccgttaaatgagcagtgaattattagatgctctcacgattcttgaaaaagaaaaaggcatcagtaaagaaattatcatcgaagcaatcgaagctgcgttaatttctgcttataagcggaattttaatcaagcgcaaaatgtacgggtggatctaaaccgtgaaactggctccatccgtgtatttgcaagaaaagatgtcgttgacgaagtatacgaccagagattagaaatctcaattgaagaggcacagggcatccatccggaatatatggtcggcgatgtcgtcgaaatcgaagttacacctaaggatttcgggcgcatagctgctcaaacagcgaagcaggtcgtcacacagcgtgtgcgcgaagctgagcgcggtgtgatttattctgaatttatcgaccgtgaagaagacatcatgacagggatcgtccagcgtctggacaataaatttatctacgtgtctttaggcaaaatagaagccttgctgccggttaatgagcaaatgccgaatgaaagctacaagccccatgaccgcattaaggtatatatcacaaaagtagaaaaaacaacgaagggtccgcagatttatgtgtcaagaacacatccaggcctgttaaagcgtttgtttgaaattgaagtgcctgaaatttatgatggaactgtcgagctaaaatctgttgccagagaagccggcgaccgttcaaaaatttctgttcgcacagatgatcctgacgtggatcctgtcggttcatgcgtagggcctaaaggccagcgtgtgcaagcaatcgtcaatgaattaaaaggtgaaaaaattgacattgtcaactggtccagtgatcctgtagaatttgtcgcgaatgcgctcagcccttccaaagtgctggatgtcattgttaatgaagaagaaaaagcgacaactgttattgttcctgattaccagctgtctctggcaattggcaaaagaggacaaaacgcacgcttagctgctaaactgacaggctggaagattgatattaagagcgaaacggacgcaagagaacttggaatctatccgagagaacttgaagaagatgatgagccgctctttacggagcctgaaactgctgaatcggatgaataagaggtgactttaggtgaataaacacaaaaagatcccattacgcaaatgtgtagtgactggtgaaatgaagcctaaaaaggaactgatccgagttgtacggtcgaaagaaggcgaaatctcagtagacccgaccggaaaaaagaatgggcggggtgcttatttaacgctggataaagagtgcatcttagcagcaaaaaagaaaaacattttgcaaaatcaatttcaatcacaaatcgatgaccagattttcgatgaattgctggaactggcggaaaaggtgaaaaaataaaatgtctggaatggaatggtttcccttgctgggtctggccaatcgagctcgtaaggtcgtgtcaggcgaagacttggtaataaaagaaatcaggaatgcgcgtgcaaagcttgtcctgcttacagaggatgcatcatctaacacagcaaaaaaagtaactgacaagtgcaattattataaagtcccttataaaaaagtcgagagtcgcgcggttcttggacgctctatcggtaaagaagcccgtgtcgttgtcgccgtcactgaccaaggttttgcgaataagctgatcagcttgctcgattaatatttttgggggtgaacgaatggctaaaatgagagtatacgaatatgcaaaagcgttaaatgtttcaagtaaggaaattttgaccgcactgaagaacatggatttagaagtgaataatcacatggccatgcttgaagaaaaggccattaaaaagcttgatgccaaatataaaaaaggcggcgcagccgctaaatctcaacagccagcagaaacgaacaaaaacaaacagccacaaggggttaatcagcaatcagctggaaatcaaccaaataaaattcgagacggaaagaagaatgacgtgcagaataatcaatttaacaaaaacaagaagaataacaacaacaaaaaaaataaacgcaacaacaacaataataaaaaccaacatcagcaaaagcctgtaaagccgaaaaaagagcttcctgagaaaattacattctctggcactttaacagttggcgcacttgctgaagagcttggcaaagagccttcagaaatcattaaaaagctgatgcttcttggcgtaatggcaaccattaaccaagagcttgataaagacacaatcgaactcattgcatcagaatatggtgttgaaacagaagaggtcattgtgcttgaagaaacagagctggaaaaatacgaagagcctgataatgaagaggatcttgaaattcgtcctcctgtcgtgacaatcatgggccacgttgaccatgggaaaacaacgcttcttgacagcatccgtaaaacaaaggttgttgaaggagaagcaggcggaatcactcagcatatcggcgcttatcaaattgaagagaacggcaagaaaatcacgtttttggatacaccgggccacgccgcatttacaacaatgcgtgcacgcggtgcagaagtaactgatattacgattctcgtcgtagctgccgatgacggtgtcatgccgcaaacagttgaagcgattaaccatgcaaaagcagcagaggttccaatcatcgttgctgtgaataaaatagataaagaatccgcaaaccctgaccgtgtgatgcaagaactgacggaatacggacttgtccctgaagcttggggcggagaaaccatttttgtgccgctttccgctttaactggaaaaggcattgatgaactcgttgaaatgattttgcttgtcagtgaggtagaggaactgaaagcgaatccgaaccgtcaggcaaaaggaacggttattgaagctgaactcgataaaggcagagggtcagtcgcgacattgctcgtacagactggaacattgcatgtcggtgatccgatcgtagtcggcaatacatttggccgtgtccgtgcaatggtcaacgacattggccgccgtgtgaaaactgccggcccgtcaactcctgttgaaattaccggtttgaatgatgtccctcaagcgggagaccaattccttgtctttaaggatgaaaaaacagctcgttctgtcggtgaagcccgtgcttcgaaacagcttgaagagcagcgcagcgataaagcgaagctcagtcttgatgacttattcgagcaaattaagcaaggtgatgtaaaagacatcaacctcatcgtaaaagctgacgttcaaggatctgctgaagctttaacggctgcacttcaaaaaattgaagtagaaggcgttaaagtgaaaatcatccatacaggcgttggtgcgattactgaatcagacattatcttggcatctgcttccaatgcaattgttatcgggtttaatgtgagaccggacggaaatgctaagagtacggctgaagctgaaaatgtagatattcgacttcaccgtatcatttacaaagtaatcgacgagattgaagctgccatgaaaggtatgcttgatcctgaatatgaagaaaaagtaattggtcaagtagaagtacgccaaacattcaaagtatctaaaatcggtacaattgccggcggatatgttactgaaggaaccattacgcgcgacagcggcctccgtttaattcgtgacggcgtcgtcatctttgaaggcgaagtagatgttctgaaacgctttaaagacgatgtgaaagaagtttcacaaggctatgaatgtggtattacaattaagaaatacaatgacattcgtgaaggtgacatccttgaagcgtttgtcatgcaagaaattgaaagaacgtgatcggatttgcggagtgtgaatgcatcatttatgatgcaggatcgctaaaagaaaagcgtgccgttctgaagcgggttttaaccagggttcaaaacaagttcaatgtttcgatttcggagattggctatcaggacacctggcaaagaaccagcttcggaatcgccgctgtttcttcctctcgcgttcaaacagaaaaagaactgcaacgcgtcctagcgtttatcgattcttttcctgaaattgaacggacgatcactaggacagagtggttttaacttagaggtgattgaattgagtatgagagcaaaccgtgtcggcgagcaaatgaaaaaagaactcggtgatattatcagccgcaagctgaaagacccgagaattggttttctgacagtaacggatgtacgtgtatcaggtgatttgcaaattgcaaaggtgtatatctcggttctcggtgacgagaaaaaacgggaagaagcgctgaaagggctggcaaaagcgaaaggatttatccgatccgaaatcggcagccgcatcagacttcgaaaaacgcctgaaattgaatttgagttcgatgaatcaatcgattacgggaatcggatcgaaacactgattcacgaattacattcagagaaaccatctgaataaaaaatgagaggataggcgtatatcgtctgtcctctttcttcgtttaaaagaaaaaagctcaaaagaaggagtgaaaagcaaatggttaacggagttctccttttacataaacctgttggcatgacatcgcacgactgtgtcatgaagatccgaaagctgttaaaaacaaaaaaagtaggacatacaggaacgctcgatccggaagtgtcaggcgtgcttccgatttgtgtaggaagagcgacaaaaatagtcgaatacttaactgaaaaatctaaaacgtatgatgcagaaataacgcttggcttttcaaccacaacagaggatcaaaccggagaaacggtggaaacaaagcctgtcaatcacgacattgataaagcggatgtagaaaaggttttaaacagtttaaaggggaaacaagaacaaattccgcccatgtattccgctgtaaaagtaaacggcaaaaaattatacgaatacgcaagagcagggattgaagtagaacgtccgaaacgtatgataaccattgaagacattgccctgacgacagagattaaacatcatggagaaaccgcaagcttccggtttacagtgacttgctccaaagggacctatgtaaggacgctggcggtcatgatcggagaaaagctcggatatccggctcatatgtctcatttaatccgtacggcatccggagatttttctctcgacgaatgctttacttttgatgagctcgaagcacaggcccaatccggaaccgtggaagagcatacagttcctattgaacgtgcgctcaatcatttgccgaaatggatcataagtgatacattagctaagaaagtagaaaatggggctttgcttgagacgcccgagcagttttctgaaatgacaagtgaagaccgtatcgccgtctttactgaatccggaacctgtttggcgatctatttccctcatcctgcaaaaaaagggctgttaaagccggcaaaagtattgatgcaaaaaagcgaacaatagaaaaaaggtgaccgttctgtgaagacgatacatattacacatcctcatcatttaataaaagaggagcaggcaaaatcagtgatggcgttaggatattttgacggcgttcatctcgggcatcaaaaggtaatctgcacagcgaagcaaatagccgaagaaaaaggtctgacattggctgtgatgacctttcatccccatccttctcatgtgttgggcagagataaggaacctaaggatctgattacgcctcttgaagacaaaataaatcaaattgaacaattaggtacagaagttctgtatgtcgttaaatttaatgaagtgtttgcttctctttctcctaagcagtttatagaccagtatattatcggccttaatgtgcagcacgcagtggcaggctttgactttacgtacggcaaatacggcaagggaacaatgaagaccatgccggatgatttagacggaaaagctgggtgcacaatggtagaaaaattaacggagcaggataaaaaaatcagttcttcgtatatccgtaccgcgcttcaaaacggagatgttgaattggcgaatgtcttgcttggacaaccttattttattaaaggaattgtcattcatggtgataaaagagggcggaccatcgggtttccgacagcgaatgtcggtttaaataacagctatatcgtcccgcccacaggtgtatatgccgtaaaagcggaagtgaacggcgaagtttacaatggcgtttgcaatattggctataagccaacgttttatgaaaagcgccctgagcagccttccatcgaggtcaatctgtttgatttcgatcaagaggtatatggagccgctataaaaatcgaatggtacaaacggattcggagcgagcggaaattcaatggcatcaaagaattaacagagcaaattgagaaagataagcaggaagccatccgttatttcagcaatttgcggaaataacttgcaacgcacgcaaattttattctaaaatatttgcatataggcacgatttttagtatgatagttttcgtagtcttaaaaccattgcttggcaatccgaagtcaccgacggttgctaggtaactggggctaaatatgatttggaggtgaaacaggatggcaattactcaagagcgtaaaaaccaactcatcaatgagttcaaaacacacgaatctgatactggatctccagaagttcagatcgctatcctaactgactcaattaacaacttgaacgagcatttacgtactcacaagaaagaccaccactcacgtcgcggtcttcttaaaatggtaggtaagcgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaatttcttataacaaatcattgaaatccttttacatactactttgacattgatatgttcaattcatttcgttcataataggagtaattgattatttcacacaacgaagagaggagttcgtaattgtatgggacaagaaaaacatgtctttaccatagattgggccggaagaacgcttactgttgaaaccggccagcttgccaaacaggcaaatggtgctgtgatgatccgctacggtgatacagcagtacttagtacagcaaccgcttcaaaagaacctaaaccgcttgatttcttccctcttactgtaaactatgaagaaagattatatgcggtagggaaaattccgggcggatttattaaaagagaaggacgtccaagtgaaaaagcggttcttgccagccgtttaattgaccgtccgatccgtcctttgtttgccgatggattccgtaatgaagttcaagtcatcagcattgtcatgagtgttgaccaaaactgctcttcagaaatggctgccatgttcggttcatctcttgcactttctgtatcggatattccgtttgaaggaccgattgcaggggttactgtcggacgcattgatgatcaatttatcattaacccgacagtcgatcagcttgaaaaaagcgacatcaatcttgtcgttgccggcacgaaagatgcgattaacatggtagaagcgggagcggacgaagttcctgaggaaatcatgcttgaggccattatgttcggccatgaagagattaaacgcctgattgcattccaagaagaaattgttgcagcagtcggcaaagagaaatctgaaattaagctctttgaaattgatgaagagcttaatgaaaaagtaaaagctttggcagaagaggatctgctgaaagccatccaagttcatgaaaagcatgcccgtgaagatgccattaacgaagtgaagaacgcagttgtggcaaaattcgaggatgaagaacatgatgaagatacaatcaagcaagtgaagcagattttatccaagctggtgaaaaatgaagttcgccgcctgattactgaagagaaagtaagaccggacggccgcggtgtcgatcaaatccgcccgctctcttcagaggttggcctcttgccaagaacgcacggttcaggtctatttacaagaggacaaactcaagccctcagcgtatgtacgctaggtgctctgggagatgtgcaaatccttgacggcttaggtgtcgaagagtcaaaacggtttatgcatcattacaatttcccgcaattcagcgttggggaaacaggaccgatgcgcggaccgggacgtcgtgaaatcggacacggagcactgggtgagcgtgcgcttgagccagttattccgtctgaaaaagacttcccttatactgtccgtcttgtttcagaagtgcttgaatcaaacggttctacatctcaagcaagcatttgcgcaagcacacttgcaatgatggatgctggtgtaccgattaaagcgccagttgctggtattgcgatgggtcttgtcaaatcaggcgaacattacactgtcttgactgacatccaaggcatggaagacgcgctcggagatatggactttaaagtagcgggaactgaaaaaggcgtaacggccctgcaaatggacattaaaattgaaggcctttccagagagattcttgaagaagcgcttcagcaggcgaaaaagggcagaatggaaatcctcaacagcatgcttgcaacattaagcgaatcaagaaaagagctttctcgatatgcgcctaagatcttaacaatgaccattaatcctgataaaatccgcgatgtcatcggaccaagcggaaaacaaatcaataagatcatcgaagaaaccggtgttaaaattgatattgagcaggacggcacaatctttatttcctctacagatgaaagcggcaaccaaaaagcgaaaaaaatcatcgaagaccttgttagagaggttgaagtcggccaactttacctaggtaaagtgaaacggattgaaaaattcggggctttcgttgaaattttcagcggaaaagacggtttggtgcacatttcagagcttgcgcttgaacgcgtagggaaagttgaagatgttgtaaaaatcggagacgagattcttgtcaaagtcactgaaattgataaacaaggacgagtgaatttatcccgcaaagcggtgctccgtgaagagaaagaaaaagaagaacaacaatcttaaatgaaaacataaaaggagcctgggagacccggcttctttattttgaagcttttcaaaagcaggcgggttctaccttgtccttctccttcataatttgaggtgaggggggacagaacatgtacaaaaaatttgtaccgtttgccgtttttttatttcttttttttgtctcatttgagatgatggaaaatccgcatgcacttgattatataggggcaatgaaaaaagatacggtgactgtcacggcgtcaaaagaccaattatatgaagaattgcttcaaaaagcgccggagtacgaagttaagccccagaatgcaagaattgataaagtatggaaaagcattccaggctacaatggattaaaggtcaatattgaacaatcatataaaaaaatgaaaaagcatggtgagtttcgggaaaaagatttggtgtacagtcaagtaaaaccaagtgttcatcttgagtcacttcagcctgagcctatttataaaggaaatcctgacaaaccgatggtggcttttttaatcaatgtggcatggggaaatgagtatttggaaaaaatgctccctattctgcaaaagcaccaggttaaagctacgttctttttagaaggcaattgggtgagaaacaatgaaaagctcgctaagaagattgcaaaagacggacatgaaatcggaaatcattcatacaatcatccggatatgagcaaactgactacaggaagaatttccgagcagctcgacaagactaatgaacaaatagaacaaacgatcggtgttaagccaaagtggttcgctccgccaagcggaagtttcagaaaagcggttatcgacattgcagcagagaaacagatgggaacagtcatgtggacagttgatacaatcgattggcaaaagccggctccgtctgtacttcagacgagagtgttaagcaagatacataatggtgccatgattttaatgcatccgactgaccctacggcggaaagtcttgaagcgctgattacacagataaaagacaaaggatatgcgcttggaacagtcactgaactaatggatgaaacaagactattgaagtaacagatgaaggcagcttgtctttgaataggaggaacaaatttgattaaacgatatacgtgtcaaaatggtgtaagaattgtgctggaaaataacccgacagtccgttctgttgcgatcggcgtatggatcggcacaggttcgagacatgaaacgccggagataaacggaatttctcactttttagagcacatgttctttaaagggacgagcacaaaatctgcacgcgagatagcagaatcttttgatcgtattggcggccaggtcaatgcgtttacttcaaaggaatatacctgctactatgcaaaggtgcttgacgagcatgcgaattacgcgctggacgtattagcagatatgttctttcattcaacgtttgatgaaaacgagctgaaaaaagaaaaaaatgtagtatatgaagaaattaaaatgtatgaagatgcgccggacgacattgtacatgatttattgagcaaagccacttacggcaatcattctttaggctacccaattctaggcacggaagaaacgcttgcttcctttaacggtgactctctcagacaatacatgcatgattattatacgccggaccgagtggtgatttcggtagcgggcaatatatctgacagttttatcaaagatgtagaaaaatggttcgggtcatacgaggcgaaaggcaaagcgacaggccttgagaagcctgagttccacacggaaaaactgacgagaaaaaaagaaacagagcaggctcatttgtgccttggatttaaaggcttagaggttggccatgaacgtatttatgatttaatcgtcctcaacaatgtgctcggaggcagcatgagcagccggctgttccaagatgtgcgtgaagataaaggacttgcttattctgtttacagctatcacagttcatatgaggacagcggaatgctcactatttacggtggaacgggtgcaaatcagcttcagcagctgtcggaaacaattcaagaaacccttgccacattaaaacgtgacggcattacctcaaaagaactggaaaacagcaaagagcaaatgaagggaagcttaatgctgagcttagaaagcacaaacagcaaaatgagccgaaacggaaaaaatgaactgctgctcggcaaacataaaacattagatgaaatcatcaatgaattaaacgccgtgaacttagagcgtgttaacggccttgccagacaattgtttaccgaagactatgcattagcacttatcagcccttccggcaatatgccgtcttaaaaaggaaagcctgctccataatggagcaggcattttttaatccctttcatcatacatagtacaagggggtgacagacatgcggctcagtgaattatcaggaaaggaaattgtagacatcaaaagagccgaacggctcggagtgctcggtcagaccgatttggaaatcaatgaacaggatggacagattacagcactcctcattcccacagttaagtggtttggtttgagaaagcaaggtcatgacattcgtgtcccatggcaccatattcaaaagatcggttcagatatgattatattagatgtacctgaggaaatgcctcctcgacaagagtaaatagcccaattgactgtgaagcgggctctaaagaaaacatctgaaacatcggctgccggagccgatgtttttttatatggaaaaagcgcatcttttatattcaccagtattttcttttgatcataagatgaaggggagcttaacaactagagatccagtatatacaaagaaggtgaacgtttagaatgttaaccggattgaaaattgcagttatcggcggtgacgcaagacagctcgaaattataagaaagctcactgaacagcaggctgacatctatcttgtcggttttgaccaattggatcacggttttaccggggcagtaaaatgcaatattgatgaaattccttttcagcaaatagacagcatcattcttccagtatccgcgacaacaggagaaggtgtcgtatcgactgtattttctaatgaagaagttgtgttaaaacaggaccatatcgacagaacgcctgcacattgtgtcattttctcaggaatttctaacgcctatttagaaaacattgcagctcaggcaaaaagaaaacttgttaaactgtttgagcgggatgacattgcgatatacaactctattccgacagtagaaggaacgatcatgctggctattcagcacacggattatacgatacacggatcacaggtggccgttctcggtctgggtcgcaccgggatgacgattgcccgtacatttgccgcgctcggggcgaatgtaaaagtgggggcaagaagttcagcgcatctggcacgtatcactgaaatggggctcgttccttttcataccgatgagctgaaagagcatgtaaaagatatagatatttgcattaataccataccgagtatgattttaaatcaaacggtactttctagcatgacaccaaaaaccttaatattggatctggcctcacgtcccgggggaacggattttaaatatgccgagaaacaagggattaaagcacttcttgctcccgggcttccagggattgtcgctcctaaaacagctgggcaaatccttgcaaacgtcttgagcaagcttttggctgaaatacaagctgaggaggggaaataaggatgtcgtcattaaaaggaaaaagaatcgggtttgggctgaccgggtcgcattgcacatatgaagcggttttcccgcaaattgaggcgttggtcaatgaaggagctgaagtccgtccggttgtcacatttaatgtaaaatccacaaatacccgatttggagagggcgcagaatgggttaaaaaaattgaagacctgactggatatgaggccattgattcgattgtaaaggcagaacctcttggaccgaagctgccccttgactgcatggtcattgcgcctttaacaggcaattcaatgagcaagctggcaaatgccatgacggacagcccggtgctgatggcggcaaaagcgacaatccgaaacaatcggcctgtcgttctgggtatctcgacaaatgatgctcttggtttaaacggaacaaatttaatgaggctcatgtcaacaaaaaatatcttttttattccattcgggcaagacgatccctttaaaaaaccgaattcaatggtagccaaaatggatctgctaccgcaaacgattgaaaaggcactcatgcaccagcagcttcagccgattctagttgagaattatcagggaaatgactaaatttacagaaaatctttcccaaactaaaaaattcggtcatcacccgcatattctatggtaaaataaaacgtaaaatcatagtcaaatcaattcaatgaagctgattggcggaaggagttttacagatgggaagaggtttacacgtagctgttgtcggagcgacaggggctgtgggacaacaaatgcttaaaacacttgaagacagaaactttgaaatggacacacttacattgctatcttcaaaacgctctgcggggacaaaagtcatgtttaaaggccaagagctgactgttcaggaagcttctcctgagagctttgaaggggtaaatattgctttgttcagcgccggcggaagcgtatcacaagcattggcaccagaagctgtaaaacgcggcgctattgttatagataatacgagcgcgttccgcatggatgaaaatacaccgcttgttgtgccagaagtgaatgaggcagacttgcatgaacacaatggcattattgccaatccaaactgctctacaatccaaatggttgcggcacttgaaccgatccgcaaagcatatggcttaaacaaagtcatcgtatcaacttaccaggcagtatcaggagcgggtaatgaagctgtaaaagagctttacagccaaacacaggcgattttaaataaagaagaaatagagcctgagatcatgcctgtaaaaggtgacaaaaaacactatcaaatcgccttcaacgcgattccgcaaatcgataaattccaagataacggctatacgtttgaggaaatgaaaatgataaatgaaacgaaaaaaatcatgcacatgcctgaccttcaagtagcggctacatgtgtgagactgccaatccaaactgggcactcagagtccgtctacatcgaaatagaccgtgatgacgctacagttgaagatattaaaaatctattgcaagaagctccgggcgtgacacttcaggatgatccaagccagcagctttatccgatgcctgctgatgctgtcggcaaaaacgatgtgtttgtaggccgcatccgcaaagacttggacagagcaaacggttttcatttatgggttgtttctgataacctattaaaaggcgcggcatggaactctgttcaaattgcagaaagcctgaaaaaactaaacctcgtataaaagagagaattttctaaagacgaatagaagagagtaaggcgctatcagcctgctctcttctgttacgtccgaataatttggagtgaaaacagtgaagataattgttcaaaagttcggcggaacatcagtaaaagatgataaaggccgcaaactggctttagggcatattaaagaagcaatcagtgaaggatataaggttgtcgttgtcgtttcagcgatgggccgaaaaggagacccgtatgcaacagattctttgctcgggctgctttacggcgatcagtcagcgatttctcctagggaacaggatttgcttttatcttgcggagagactatttcctctgtcgtctttacaagcatgctgcttgataacggtgtgaaagcagctgcgctgacaggggctcaggctggctttttaacgaatgatcagcataccaatgcaaaaatcattgaaatgaaaccggagcgtttattcagtgtgctcgccaatcatgatgcggtagtcgtcgcaggcttccagggcgcaactgaaaagggtgatacaactacaatcggcagagggggcagcgatacgtctgcagccgcactcggagcagctgttgatgcggaatacatcgatattttcaccgatgtagaaggcgtgatgactgctgacccaagagtggtggaaaatgcaaaaccgcttcctgttgtgacgtatacggaaatctgcaacctggcgtatcagggggccaaggtcattcatccgcgtgcggtggaaatcgcaatgcaggccaaggttccgatccgcgtccgttcgacttattcgaatgataaaggtacattggtgacatcacatcactcttccaaggtcggcagtgatgtttttgaaaggctgattacgggaatcgcacatgtcaaagatgtcacgcagttcaaagtgcctgcgaaaatcggccagtataatgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagtgtttgaactttcgaagtaaatgtgattgaatcatgatgaggtgaataaaatgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactggaagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcggacattccgaatgtggttgcgattaaagaagcgagcggagacctagaagcgattacaaaaattattgctgaaacaccggaagacttctatgtctattcaggggatgacgctctgacgcttcctattctttcagttggaggaagaggagttgtatcagtggcgagccatattgcaggctctgatatgcagcaaatgatcaaaaattatacgaatgggcaaacagctaatgcggcactgatccatcagaaactgctgccgattatgaaggaactgtttaaagcgcctaatcctgctccagtcaaaacagcgcttcagctgagaggtcttgatgtcggttctgtgcgtctgcctctagtcccgttaactgaggatgaacgtctgagcttaagcagcacgatcagcgaactgtaagaaaatttcatacagtgaaacaaacgcggtcattctcacattcagctgagtttgaccgtttcttttacatattggttttccctaaaccttctgctttatcttgttttctaaatttactttcagttataataggaacaagtgatgatggacgggtatgagactaggaggatatagattttgaaaaagaaaaatacagaaaacgttagaattatcgcccttggcggtgtcggagagattgggaagaacctttatgtcattgaaattgactcggacatatttgtcgttgatgccggccttatgcatccagaaaacgaaatgctcggtattgatgtagtgattcctgacatatcatatttgattgaacgggctgaccgcgtcaaggcaatctttttaacgcacgggcacgatgaaaatatcggcggcgttttttacttattaaacaagctgtccgttccagtgtacggaacaaaactgacgcttgcattgttaagagagaaattaaaacaatacggacataaccgaaaaactgatttaagggaaattcactcaaaatctgtcattacatttgaatcaacaaaagtatcgttctttagaacgattcacagcattcctgattctgtaggtgtgagctttaaaacatcacttggatctattgtatgcacgggagacttcaaatttgaccaaacacctgcacttaatcagacgtgcgacattggcgagatcgccaagatcggcaatagcggcgtgctcgctcttctttctgacagtgcaaatgcggaacggccgggttacaccccttcggaagcggctgtcagcggagaaatttcggatgcgctgtataattcacagaaccgggtgattattgctgttttcgcatccaatattaaccggattcagcaagtcattcatgcagcggctcaaaatggcagaaagattgccgtagccggaaaaaatcttcaatctgtcctgcagctggcgagaaagttaggatacattgaagcagatgatgaattgtttatttctgtacaggatgtcaaaaaatatccgaagcgcgaagtggccattattacagccggaagccaaggtgaaccattagctgctttgacaagaatggcaaacaaagctcacaaacagctgaacattgaagaaggggatacggtggtcattgcgtcaactccgattcccgggcaggaactcatttactctaaaacagtagatcttcttgcgagagccggtgcacaagtcatctttgcccaaaagcgtgttcatgtatcaggccacggctcacaagaagagttaaagctgatgatcaacctgcttaaaccaaaatatttgattcctgtaaacggcgaatacagaatgcaaaaagctcattcgaaaatcgctgaagaaaccggcatgaagcgcagtgacatcttcttaattgaaaaaggagacgtcgttgaattccgcggccaaaacgtaaaaattggggataaagttccttacggcaatattttgattgatggtttaggtgtcggtgatatcggcaatatcgtattgagagaccgccgcttgctttcacaggacggaattttaatcgttgtcattacacttgataaacaaaagaaacatcttgtatcaggaccagaaattatcactcgcggctttgtttatgtaagagagtctgaaggtctaatcgtacaggctactgagctcgtccggtccatcgtgacagaagcgactgaaacatcaaatgtcgaatggtcaacgctgaagcaggcaatgcgggatgctttgaaccaattcctttatgaaaaaacgaaacgtaaaccgatgatcatcccaattattatggaagtataatgactgactaaagaccggagctgctccggtctttattttttgtccttcaagccgggattgaatgaagtatctttgttcataatacaaagagaaactcggaaaggatgaaagcgagatggatcatcgtatggaaaacacagaagaagagcgtcctgaaaaaaatgatgcgaaggacagcattatgaataaaatacagcagcttggtgaaacgacgcttccgcagctgccccaagatacaaatattcattgtctgaccattatcggacaaattgaaggccatgttcagcttcctccgcaaaacaaaacaacaaaatatgaacatgtcatcccgcagattgtggcaattgaacaaaatcccaaaattgaaggcttgctgatcatattaaatactgtcggaggagatgttgaagctggtcttgcaatagcggaaatgcttgcatctttatcgaaaccgaccgtttctatcgtgcttggcggggggcattccatcggcgttccgattgctgtatcctgtgattacagctatatcgccgaaacagcaacgatgacgattcatccagttaggctcaccgggctggtcatcggggtgccgcaaacgtttgaatacctggataagatgcaagaaagagttgttaaatttgtgacaagccattccaatataaccgaagagaaatttaaagagctaatgttttcaaaaggaaacttaacacgggatatcggaacaaatgtagtcggtaaggatgcagttaaatacggattgatcgatcacgcaggcggtgtcggacaggcaatcaataaactgaatgagctcatcgacgaagcaaggaaagaagaaggacggatgattcaatgattctttataccgtgatgccgcaggaaattgtgtttgcagaacagaaccaagagacaagcgcacatgagcaaattgaatataaaggtgtaccgcttctagtcgaaatgaaagggaatgaagcggaagtcattcaaatcatgagcaccaatccaatgcattttctgcatccggacatttcacccggacaaaagctgaaattaaacgtataagaatccaacccttttttaagggcaaaatatgctataataggggaatcctatagaaaaaacgcagcctgtaaacggctgctttcttcattatgtatgaacttacattttttaacgcagtaaggtgatgagtgtggcaaagaaaaaacgaaaatcaagaaaaaaacaggcgaaacagctaaatataaaatacgagcttaacggattgctgtgtatagccatttcaattatcgcaatcttgcagctgggggtagtcgggcaaacgtttatctatttgttccgcttttttgctggagagtggtttattttatgcttgttaggtttattggtgttaggagtctcactgttttggaagaaaaaaaccccaagccttttaacgagacgaaaggccgggttgtactgtatcatcgcaagcatattgctgctttctcacgtgcagctatttaaaaatttgacgcacaaagggtctattgagtctgcaagcgtggtgcgcaatacgtgggaattgtttttaatggacatgaatggcagctctgcttcacctgatttaggcggagggatgatcggtgcgctgctgtttgcggcttcacactttttgtttgcgtcgactggttctcagatcatggcgattgtcatgattttgatcggaatgattttagtaactggacgctcgctgcaagaaacgctgaaaaagtggatgagcccgattggacgttttataaaagaacaatggttagcatttattgatgatatgaaatccttcaaatcaaatatgcagtcatcgaaaaaaacgaaagcgccgagcaaaaaacaaaaaccggcccgcaaaaaacagcaaatggaaccggagcctcctaatgaagagggggattatgaaacagtatcgcctcttattcattcagagccgattatctcaagcttttctgatcgtaatgaagaggaagagtctccagttatagaaaagcgccccgaacctgtgtcgaagccgcttcaggacatccaaccggagacaggtgatcaggaaactgtttctgctcctcctatgacctttacagagctcgaaaataaggattacgagatgccgtcactggatttgctggcagatccgaagcataccggccagcaggctgataaaaagaatatttatgaaaatgccagaaagcttgaacgcacattccaaagctttggcgtaaaggcgaaagtcacacaggttcatctcggaccggccgtaacaaaatatgaagtatatcctgatgtcggagtgaaggttagcaaaattgtcaatttaagcgatgatttagcgcttgcgcttgctgcgaaggatatcaggatcgaagcgcctataccaggtaaatcagcaatcggaattgaagttccaaacgcagaagtggcaatggtttcgctgaaggaagtgctggagtctaaattgaatgacagaccggatgcgaagctgttaattggactcggccgcaatatttcaggtgaagctgtattggctgagttaaacaagatgccccaccttttggtcgcaggcgcaaccggtagcgggaaaagtgtctgtgtcaacggcattattacaagtattttaatgcgcgcgaaaccgcatgaagtgaaaatgatgatgatcgatcctaaaatggtagagctaaatgtctacaacgggattccgcatttgcttgctccggttgtaaccgatccgaaaaaagcgtcgcaggctttgaaaaaggttgtcaatgaaatggagcggcggtacgaattattctctcatacgggtacaagaaatattgaaggatacaatgattatataaaacgcgccaacaatgaagaaggagcgaaacagccagagctgccctatattgttgtcattgtggacgagcttgccgatctcatgatggtcgcttcatctgatgtggaagattcgattacgagattgtcccaaatggcgcgggctgccggcatccatcttattattgcgacacagcggccatcggtggatgttatcacaggggtgatcaaagcgaacattccgtcacgaatcgcgttcagcgtatcttcacagacggattcaaggaccattcttgacatgggtggcgctgagaagcttcttggccgcggcgatatgctgtttttacctgtaggggctaacaaacctgtccgtgtgcagggagcatttttgtcggatgacgaagtggagaaggttgtcgaccatgtgattacgcagcagaaagcgcaatatcaagaagaaatgattcctgaggagacaacggaaactcattccgaggttactgatgaactttatgatgaagctgttgaattaatcgtcggcatgcagacggcatctgtttcaatgctgcaaagaagattcagaatcggctatacgagagcggcgcgcctgattgacgcaatggaggaacgcggtgttgtcggaccgtatgaaggcagcaaacctagggaagtattattatcaaaagagaaatatgatgagctctcttcttaatgaagggagttccgctttctatagttgtcgataataacattatgtaaactaatcacctttctatttattttttcgacaaaacatgatatagttgtcccaattgttcaataatttttatcgaaagtggtttacggaggggaaacatgtctacaaaagctgataatcggcacttgtatttgaaagtaattgaacgaattaaagaggatataaaaaatgggatctacactgagaaggaaaagctgccttctgaatttgagctttccaaaaagcttggtgtcagcagagcgacgctaagagaagccttgcggatactggaagaagagcatgtgattatcagaaggcatggtgtaggcacttttgtccattctaagccgttatttctttcgggcattgaacagctgaacagtgtaaccaagatgatagaacaggcgaatatgacccctggcacgatttttctatcatcacaagtgcttatgccgtctgaagatgatacgaagagatttcatttggcagaagggcaagaacttttttaccttgaacgagtcaggacagctgacggacagccgattgtgtattgtatagacaaaattccgatgaatattttgccgaattctttttctcatcagcaagaatctatgtttgacctgcttgagaaaaattcaggctccgtaatcagctatgcagtaactgatatagaaccgatcggttatcacgataccatttctccagtacttgaatgcgatccggaaacagctcttttgctgttaaaacaaacccattacgatcagcacgataaaccggtgctttattctttaaattattttagagcagataaattcagatttcatgttttgcgtaaacgattctaaaaacggacgcctgtatgtgtctgtttttttatttgcactgattcatgtttctttgtacatactttcattccggttaacgcaatatataagggatgacaagaaagtgaatgggtgaaaatgttgagagagaaaaatggaatgaaaaatattattgcattgtcttccgtcccgcttgtgatgacactcgggaactccatgctgattcctgttcttccgatgatggagaaaaagctgtctgtgacttcatttcaagtgtctttaatcattactgtatactcagtagtagcaattatttgcattccgattgccggatatttgtcggatcgtttcgggagaaaaaaaatattgcttccatgcctcctcattgcaggattggggggagccgtagctgcttttgcctcgacctatatgaaaaatccttatgctatgatcttggcggggcgggttcttcaaggcattggttctgcaggtgccgctccgatcgtcatgccgtttatcggcgacttgtttaaaggagacgatgaaaaggtcagcgctggtcttggcgatattgaaaccgccaacacgtcagggaaggtactgagtcccatacttggagccttactggcttcttggtattggtttgtaccgttttggtttattccgtttttctgtttgatcagctttttgctcgtattgtttttggtggccaagcctgaagaagatgaagatgcgcctgctgtttctgagtttattaagagtgtgaagaaaatttttaaacaggatggtcgctggctttatacggtcttcattatcgggtgtgtcattatgtttttgttatttggcgtattattttatttatcagatacgctggagaacaagtatgctattgacggagtagctaaaggcggattactggcaatcccacttttgtttttgtcaaccagttcttttatagctggcaaaaagatcggtaaagataaaggccgaatgaaattttgcgttgttacaggaatgattctgttaaccctttcgtttattgccttgtggtggaaccacagtttttattttttatttgtctttttaagctttggcgggattgggattggaatggctcttcctgctttagatgcattgataaccgaagggattgaaagtgaacaatgcggaaccatttcctccttctacaatagcatgcgctttataggagtagctctcggtccacctgtttttgctgcattaatgtctaatgcaaactggattattttcatactctcggcgttttgcagcatcgtttctttatttttagtgctctttactgtagatgctaaaaaaagtgaagaagaagaaaaaaacttagggacggtctagccagccgtctttttttgcgctttcttgcacagtttacaactgtacctatacagcatgcggaggttattgtttccttataaatcctacagttgctataattacatgaaagagtgtttctgcgaatgctgaaaattggtcataatacatactaattaagaaatgaacgaaggaggttccatatgtcatatgttaatgaactcaaatcaaagcacggcggtttaaccgcacacattgtagaaacagaaaaattcaaaaccgtctcgcttatttttaagatgctggcgccgctgacaaaggatcaagtcaccaaaagagcgctgctcccgcatgtgcttcttcgcggaacgaaaagccatccgaaaaccgcagaattgcgttcatacctggatgagctgtacggcacgtcagtatcggctgatcttacgaaaaaaggagagcggcacgtcattacgttcaggcttgaaatcccaaatgaaaaatatttaaaagaccaatcgccgctacttgagaaagggctccagcttcttgcagaaatcgtcttttcacctgctttagagggggacgcttttcagtcacaatatgtggctcaagaaaaacggacgcttaagcaaagaatccaagccgtctatgatgataaaatgcgctattcgaatttaaggctgatacaggaaatgtgcaaaaatgagccttacgcgcttcatgtcaatggtgaaatcgacgatgtcgatgacattacggcagagcaattatacgaaacataccaaagcgctatccaaaaagaccagcttgatttatatgtagttggcgatgtggacagtaaccaggtacattcggcaattgataagtatttcaaaacagaagagcgcactcttggcacgattgaaaacaatcacgctgatgaaaaagttcagccaaaagaagtaattgatgaagaggatgtcaagcaaggaaaactgaatatcggctaccgcaccagcatcacttatacagatcaggattatcctgctttacaagtgtttaacggattgttcggcggattctctcattctaaacttttcattaatgttcgggaaaaagccagtcttgcttactacgcggcttcgcgtatagaaagttttaaaggcttgttaatggtgatgtcaggcattgaagtgaaaaattatgaacaggcggtttcgattattgctgagcaattccaggcaatgaaaaatggcgatttcagtgagcaggatatagcacagacaaaggctgtcattcgaaatcaagtgctggaaacgattgatacagcatacggtttatctgagtttttatatcagcaggccgctgctcaagtcgagattcctatcgaagactttcttgccaatattgagaatgtcacaaaagaggatatcattaaagccggcgaaaagattcagcttgatacgacttatttcttaaaagggacggagggtgcatcttgatcaaaccaatcgaatatgaacagcttcaggagacgctgtatcatgaaaaaatgtccaacggccttgatgtttacgttttgccgaaaaaaggcttcaacaagacatatgcggtctttacaacaaagtacggctcgatagataaccggtttgtccctttaggtaaaaacgagatggttcacgtgccggacgggattgctcactttcttgagcacaagctgtttgagaaagcggacggagacgtttttcaagatttcagcaaacagggggcttctgccaatgcgtttacgtcatttacaagaacggcttaccttttctcaagcacatcaaatgttgaacgcaatttagagacgcttatcgatttcgtacaggacccatattttactgaaaaaacggttgaaaaggaaaaagggattatcgggcaagagattaatatgtacgacgataaccctgattggaggctttacttcggggtcattgaaaacatgtacaaagagcatcctgtcagaattgacatagcgggaacagtggaaagcatttcacatattacaaaagaccttctttatgaatgctatgaaacgttttatcacccgagtaacatgctccttttcattgtcggacctgtagatcctgaagcgattatttctcaggtaagagaaaaccaggggaaaaagccgtatactgatcagccggagatcaaacgggaagaagtgaaagagcaagaagcggttttccgaaaagaaaaagagatcaaaatgaacgtgcagggaccgaaatgccttgttgggctgaaatccaaaaatccgtttaaattaggcaaagagctcttaaagcatgaactttcaatgaacttattgcttgaagctctttttggcaaaagctctgcccagtatgaatcactttatgaaaaaggatatattgacgaaacgtttagctttgattttactgctgaatatgggtttggttttgcggcgatcggcggagatacgcctgagcctgatcaattggctgaagacatttcaagcatgcttttgcgcgccggtgaactggttactgctgaaaagattgaacttgccagaaagaaaaagattggtacattcttaaaagcgctgaattcccctgaatacatcgccaatcaatttacccgttatgcgttcttggatatgagcctgtttgacgttgtaacggtactcgagcagattacccttgaggatgtccagaacgtaatacaagaggaaatcgctgcagacaggctgactgtctgcaaggttgttcctaaatcataaataaaacatccctccagtgtgaggggtgtttttctgcggaaagaaggaaagaggatgaacaaaacagcactaatcaccggagcaagcggcggcattggcaaaagcatcagcgaaacccttgcggctaagggatacaatctgctgctgcattacaatacaaatcaatacgcggcagcggagcttgctgaaaaactaagtcagatgtttggcgtaaatgcggagatattacaagctgatctgtctgcgcaagatggagcagataagctgacaagttcaattgttcagccgattgatgcgattgttttaaacagcggacgaagccattttgggctgattacggatgtagataacgcaacggttcaggaaatggttcagcttcatgtggcaagtccgtatatgctgacgagaaaccttctgccaggcatgattcggaataaatcgggagcgattgtggctgtcagctcgatttggggagagactggagcatcctgtgaagtactgtacagcatggcaaaaggagctcagcattcatttgtaaaaggattggctaaggagctggcaccaagcggaatcagggtaaacgcagtagcgccaggtgcagttgatacaaatatgatgaatcaatttaccccggctgaaaaagaagagatcgctgatgagattccgatcggccggctggcccggccgcaagaaattgctgatgcaacagcttttctcctgtctgaaaaagcgtcatatatcaccggccaaattctgtcggtgaatggcggctggcactgttgacacgaaaatattcggtgtatagtttcttttgtgaaggacacaataatcttgtaacttcacatgaaatggaggaaacaagcatgtcagtattagaaaactgggatagctggaaaaacttccttggcgaccgtctgaactatgcgcaagataaaggtatgagccaggatacgattacagatcttgcgacagaaatcggcagctacttggctaatgaagtggaatctaagaacgagcaggaaaaagtgctggcagatctttggagtgtagcatcaaaagatgaacagcacgccattgccaatatgatggttaagcttgttgaaaataacagcactcactaggaagagaggggatttttcctctcttttttatgttttcctcatcacagcaacattcttctttctaattagagaaaaatgctttatgataaaggaaggtaaaattttgccacaatgaagggggtatatcatttggcaaagctcgaatggtattttgaatatgaaattcaagtgaaccgccccggactgctcggggatatttcatctcttcttgggatgctttctatcaacatcgtaacgataaacggcgtcgatctttccagaaggggaatgcttctcaggtgccgccatatagatcaaattaaacgattagaatcaatcttaaaaacgatggaaacaattaaagtaacgaagcttagagaaccgaggcttcgcgaccgacttgccgtacgccacggccgttatattcaacgggatgccgatgacaagaaaacgttccgctttgaacgggacgagcttggcttattagtcgattttatggccgaattgttcaaaaaagaaggccataaattaatcggaatcagaggtatgccgcgtgtcgggaaaacggaatcgattgtagcctctagtgtgtgtgcaagcaaaaggtggctgtttgtgtcatcaaccttgctgaagcagacgataagaagccagctgattgccgatgaatacagcactgaaaatgtctttatcgttgacggaattgtgtcaacacgaagaggatcggaacgccatctccagctggtccgagaaatcatgcggctgcctgcaacaaaagtggtggagcatccggacatattcgttcaaaatacagagtatacactagatgactttgattatattattgaactgagaaatgaccctgatgaggttattacatatgaacatgccgaggaaccccaaatgtttgatcaatccgggttttcaagctttgatttttaaaattggaaggtgtttgttgtgactgaactaggaatccggctcaaagaagccagagaggaaaaagcaatgtcattggatgatctccaagcggcaacaaagattcaaaaaaggtatttaaccgccttggaggaaggaaactatgacattattccggggaagttttatgttcgggcattcatcaagcaatatgcagaagccgttgggcttgatgcggatcagctgtttgaggagcataaaaaagatatccctaatacgtatcatgacgatgtgtctgaaaagatctccggcatgaatcttcaaaaggaaatgccgaagccagcatctaaggcgctggagctgctgccaacgatacttgttattctcggcgtgattgtcgtgattgccattgtgtacgcgatcattcagtttgccaatcacaaaaacagtgatgatcacaatgcggcatcagaaaaagcaattacgcaaagtgagagcaagtacgaaatccctaaagattcaacgctgaaagagaatcaaaataacagctctgaaaaagagacagacactaaaaaagaaacgaaagaaaacgaagataagaaaaaagaaaatgacagtgataagctggagattaaagctgctggcactgaaggatcgttaacgacttatgaagtgtccggcgctgataaaatcgagctggaactgaaggcatcagacagctcctggattcgagtgcgcgatgaaaacagcagctctttaaaagaaggaacgctgaaaaaagacgagacctataaaaaagacataactgatcagaaacaagttgatatccgcaccggatatgcacctaatctgaaaataaaaatcaacggtaaggttctttcatatgaacttgatccgaaaaaagtgatggcacaaactataaagattgtaaataaaaaggaagaaaagtcatcttaattaccagatgacttttcttcacgtccgagtatgaaattggaggggctttatgtttaacttaccaaataaaatcacactagctagaatcgcattaatcccaatcttcatgattatcatgctggcgccgtttgactggggcaggctcgaagttggagacgaatcgatcccggtcgcacatttggcgggggccattctatttattattgcatctacaacagactgggtggacgggtattatgcccgaaaattgaatctcgtaacaaacttcgggaaatttcttgatccgcttgcggacaaactgctggtatccgcagcgttaattatccttgttcaatttgatctcgctccagcttggatggtcattgtgattatcagcagggagtttgccgtgacaggtttaaggcttgtcttagccggaacaggagaagtcgtagctgctaacatgcttggtaaaatcaaaacctgggcacagattattgcggtatccgcattgcttcttcataatcttccatttgaacttgtgtcattcccgtttgcagacttggcgctgtgggtagccgtcttctttactgtcgtctcaggctgggaatatttctctaaaaactgggaagcgttaaaaacatctaactaagaaagaaggacttcgtcatggaatttccaaaaaaagcagaaataattgcagtcggttcagagctgctgcttggccaaatcgccaatacaaatgctcaatttatcagcaaacagctcgctgaaatcggggtcaacgtattttatcatacagcggtcggagataacccggagcggctgaagcaggtcatccgcattgctgaagaacgctctgacttcattattttttcaggagggcttggacccacaaaagatgatctgacgaaagaaacgattgcaaatacgctgggacgtccgcttgtgttaaatgatgaggcattccaatccattgaggactatttcaaacgaacaaaacgcacgatgtcacctaataaccgaaaacaggcgcttgtgatcgaaggttctgacgtgctggcgaatcactttggaatggccccgggaatgctcacagagcatgaatcgcgctattatatgcttcttcctggaccgccgagcgaattgcgcccaatgtttgaaaacgaggcaaagcctcttctgctgaaaaagatgggttcaaatgaaaaaattgtgtcaaccgttcttcgctttttcggtatcggtgaatctcagcttgaagccgatttggaagatattattgatgcgcaaaccaatccgacaattgcgcctttggcggctgatggagaggtgacgctgcgtctgacagccaaacacgccgatgaaaaggaaacagagcgtctgttaaaagaaacagaggccgttatcttagagcgtgtcggtgaatttttctatggttacgatgatacttctcttgtaaaagagctatctatagcgtgcaaggaaaaaggcattacaatttctgcggcagaaagttttaccggagggctgttttctgaatggctgacggatcatagcggtgcctcaaaattatttgccgggggcgttgtttgctatactaacgacgtgaagcagaatgtgcttggtgtcaagaaggaaacattagatcgttttggggcggtcagcaaggagtgcgcatccgaactggctaagggtgttcaaaaactcactggcagcgatatcggcattagctttactggtgtagcaggacctgatgctcaagaagggcatgagcctgggcatgtgtttatcggcatttccgcaaatggtaaagaagaggttcacgagtttcactttgcgggctccagaacggggatcagaaaacgcggcgctaaatacggctgccatttaatcttaaagcttttagagcaaaaataatattttcagcacattatcctcctaagaaaacatgatttctctgatacattatgatattttgataggaatcacgccaagaaaaaatccgaatatgcgttcgcttttttcttggcaaatcccttcaaacagggtatagtatatgtagtggtaacataaaggaggaaaaaatagaatgagtgatcgtcaggcagccttagatatggctcttaaacaaatagaaaaacagttcggcaaaggttccattatgaaactgggagaaaagacagatacaagaatttctactgtaccaagcggctccctcgctcttgatacagcactgggaattggcggatatcctcgcggacggattattgaagtatacggtcctgaaagctcaggtaaaacaactgtggcgcttcatgcgattgctgaagttcagcagcagggcggacaagccgcgtttatcgatgcggagcatgcgttagatccggtatacgcgcaaaagctcggtgttaacatcgaggagcttttactgtctcagcctgacacaggcgagcaggcgcttgaaattgcggaagcattggttcgaagcggggcagttgacattgtcgttgtcgactctgtagccgctctcgttccgaaagcggaaattgaaggcgacatgggagattctcatgtcggtttacaagcacgcttaatgtctcaagcgcttcgtaagctttcaggggccattaacaaatcgaagacaatcgcgattttcattaaccaaattcgtgaaaaagtcggcgttatgttcgggaacccggaaacaactcctggcggccgtgcgttgaaattctactcttccgtgcgtcttgaagtgcgccgtgctgaacagctgaaacaaggcaacgacgtaatggggaacaaaacgaaaatcaaagtcgtgaaaaacaaggtggctccgccgttccgtacagccgaggttgacattatgtacggagaaggcatttcaaaagaaggcgaaatcattgatctaggaactgaacttgatatcgtgcaaaaaagcggttcatggtactcttatgaagaagagcgtcttggccaaggccgtgaaaatgcaaaacaattcctgaaagaaaataaagatatcatgctgatgatccaggagcaaattcgcgaacattacggcttggataataacggagtagtgcagcagcaagctgaagagacacaagaagaactcgaatttgaagaataaaaataaaataagtttcaaatgatacaaaaggctgagtgaaaaactcagcttttttgtattttgcaaaaaaatgataaaaatattgctttttttgacaacttttttagggctttattcgtctaacaaaacgtgtgcaaaatggaatttattttgggaggaaaaaatgaatgacaagcccaacccgcagaagaactgcgaaacacagacggagaaaactaaataaaagaggaaaactgttgcttggtcttttagcagtgatggtttgcattacgatttggaatgctcttcatcggaatagtgaagaaaacgaaccatctcaagaaactgcagcggtttcaaataccgatcagaaaaaagaggtcaaaaagaaaactgccaaaaaatcagaggaacaaatcaaaacagtggatcgaaatcaaaaaatcagcaattatttagaagaaatcggtttcagcggaacagccatgattgtcagaaatggagaaatcgtaacaaataaaggttttggctatgctgaccgtaaacactacattcaaaataatccattgacatctttttatgtcggttcatcacaaaaagcgctgattgcaactgctattttgcagctagaggaaaaggggaaacttcagacaagtgatccggtaagtacgtatttacctcattttcctaacggacaaacgattactttgaagaatctgcttacacatacatcggggataaacggacatattgaaggagacggcgccattacgccggacgatttaataaaagacatagaactgcagggaatcaaacgtcagccgggcgtatgggactaccaggattccaactattctgttctcgcttatattattgctgaagtaagcggtgagccctatgaacagtacataaagaatcatatttttaaacctgcgggaatgacgcatgcaggcttttacaaaacatatgaaaaagaaccttatcctgctgtcgggtataagatgaagggcggcaaaacagttacaccgtatatacctgatctatctcagctgtatggagcgggtgatatttatatgagcgctatagatatgtacaaatttgaccaagcgctgatagacggaaaactgtattcgcaaaaaagctatgaaaagatgtttacgccagggagcagctccacatacggcatgggattttatgttgatcccggaagctattcaaaccatggtgttatgcccggcttcaatatcttgaacagctttagtaaatctgggcaaaccattgttattttgttctcaaacattcaaaataatgctaaattgggccaagtgaacaataaaatataccagcttctgaatcaagaatgattggcgttcttcttttggatgaattgcattcggaacgtgaaaagacgactggcctgcaaacgttaagatggcaagcttgacaagtatttccgacacatttacaatgaagttgtaacatttgtttttttaacatgattgttaaaccatttaaacttgacaagggcgatgaacacactcattccctgtgaaggttctgtatgttgagaaaactagacaatgtacatgccgacactttttaagcaacaaccaagttcatagcaagaggaggtgaaagtatgaccccaattatgatggttctcatctccattttgctgattctactcggtttagttgttggctactttgttcgtaaaaccattgccgaagcgaaaattgcgggcgcacgcggtgcagccgagcaaattcttgaagatgcaaagcgtgatgctgaagcactgaaaaaagaagctctgcttgaagcaaaggatgaaatccacaaacttcgaatagatgctgaacaggaagttcgtgaaagacgaaatgagcttcaaaaacaagaaaaccgtttactccaaaaggaggaaaaccttgatcgcaaacatgagggaattgataaacgggaagcgatgttggagaagaaagatcattctctgaatgaacgacaacaacatattgaagagatggaaagcaaagtggatgagatgattcgtatgcagcagtcagagttggaacgaatttcgagtctgactcgtgatgaagcaaaacaaatcattcttgagcgggttgaaaacgagctttcacatgacatcgccatcatgacaaaagaaactgaaaaccgtgcgaaagaagaggcggataagaaagcgaaaaacattctttcactcgccttacagcgctgcgcagcggaccacgttgccgaaacaacggtatcagttgtcaatcttccaaatgatgagatgaaaggacgtatcatcggacgggaagggcgtaacattcgtacgcttgaaacgctgacaggaattgacctgattattgatgatacacctgaagctgtcattctttccggatttgatccgatcagacgtgagacagccagaattgctcttgataaactcgttcaggatggccgtattcatccggcacggattgaagaaatggttgaaaaatctcgccgcgaggtcgatgactatattcgtgagatgggtgagcaaacgacatttgaggttggcgttcacggcctccacccagatctcatcaagatcctcggccgcttaaagttccgtacaagctacggtcaaaatgtgcttaagcattccatggaagtcgcattcttggccggtctaatggcatcggagcttggtgaagacgcaaagcttgctaaacgtgcgggtcttcttcacgacatcgggaaagcaattgaccatgaagtagaaggaagccacgttgaaatcggggtagagcttgcgaccaaatataaagagcacccagtcgtgattaacagtattgcatcacaccacggggatgaggagccgacttccattatcgctgtgctggtagctgcagcagatgcgctttccgctgcaagacctggcgcaagaagtgagacgctcgagaattatattcgaagacttgaaaaactcgaagaaatttctgagtcctacgaaggtgttgaaaaatcatttgccattcaggctggacgcgaagtgcgtattatggtgaagccggattcaattaatgatcttgaggctcatcgactggcgcgagatatccgcaagcgaattgaggacgagctcgattatccaggtcatattaaggtgacagtaatcagagagactcgagccgtagagtatgcaaaataaagtgatgcgctaagcatcactttatttttttgacagcaaggaattttcaagaagaaaggatttacaaaatgagaattttatttatcggagatgttgtcggttcaccgggccgtgacatggtcaaagaatatgtaccaaagctaaaaacaaaatataagcctcactttaccattattaatggtgaaaacgccgcacatggaaaaggcctgacggaaaaaatttatcacagcttaatccagtccggcgcagatgcaatcacaatggggaaccatacatgggacaaaaaagaaatatttgattttatagatgacgttccgaacttggttcgcccggcaaactttcctgaaggaacaccggggaaagggatcacatatgtgaaagcaaacggcaaagaactagcagtcattaatttgcagggacgtacgtttttgccgccgcttgatgacccgtttttaaaagcggatgaattgatcgcagaagctgcgaaaagaacaccgtacatttttatcgactttcatgccgaagcgacaagtgaaaagctcgcacttggctggtacacggatgggagggcgtcggctgtagtaggaactcatacacacgtgcaaacggcggataaccgcattttgccgaagggaacggcatatattactgatgtgggaatgactggcccatatgacggtatactggggatggacagagagacgattattaagcgattcaaaacgaaccttccagtccggtttactgtcgctgaaggaaaaacaacgctcagcggagttgtgattgacattgacgatcaaacgaaaaaagccgtgaaaattgagcgtattttaatcaacgatgatcacatgttctttgaatagttgaacatatggttattttataaaaatattaaaaagaaaagcaggaatatagcaactccttagtgaatatagtaaaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcgagtccaaattcagtggcaggtgcgcttgcaggcgtgttgagagagcgaggagccgccgagattcaagcgatcggagcgggtgcattaaaccaggctgtaaaagctgtggcgattgccaggggatttgtggcgcctagcggcgttgatttgatttgtattccggcttttacagatattcaaatcgatggggaagaaagaacagcgattaaattaatcgtggagcctcgctaaaaacaaataaagcattctcaacctgtttgcgtaatgcaaacaggttgtttttcatttattgtgatattttctcccaatagtatttttagcacataaatgagcgaatatacaaaatcagaaatgagctaaaacgtttcaaaaaaaattccgctcatttttcaagacagatacttttgtccttatggagaagacagtgctgtttacgcttattccatatcatggtacaatccgaatataacaagaatttttcaaggaggattgtacatgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagaggacgtgggagagaatgtcagcagtgtaaaagtgggagagtatgtgtctgcggaaacacacattgtctgtggtgaatgtgtcccttgcctaacaggaaaatctcatgtgtgtaccaatactgctataatcggagtggacacggcaggctgttttgcagagtatgtaaaagttccagctgataacatttggagaaatcccgctgatatggacccgtcgattgcttccattcaagagcctttaggaaatgcagttcataccgtactcgagagccagcctgcaggaggaacgactgcagtgattggatgcggaccgattggtcttatggctgttgcggttgcaaaagcagcaggagctcctcaggtgatagcgattgataagaatgaatacaggctgaggcttgcaaaacaaatgggagcgacttgtactgtttctattgaaaaagaagacccgctcaaaattgtaagcgctttaacgagtggggaaggagcagatcttgtttgtgagatgtcgggtcatccctcagcgattgcccaaggtcttgcgatggctgcgaatggcggaagatttcatattctcagcttgccggaacatccggtgacaattgatttgacgaataaagtggtatttaaagggcttaccatccaaggaataacaggaagaaaaatgttttcaacatggcgccaggtgtctcagttgatcagttcaaacgtgatcgatcttgcacctgttattacccatcagtttccgttagaggagtttgaaaaaggtttcgaactgatgagaagcggccagtgcggaaaagtaattttaattccataaagggggataaacatgacgaaggaatttgagtttttaaaagcagatcttgatagtatgaaagaaaaccatacatggcaagacataaaacagcttgaatctatgcagggctcatctgtcacagtgaatcaccaaaaagtcattcagctatcttctaataattacctcggattcacttcacatcctagactcatcaacgccgcacaggaggccgttcagcagtatggagccggcaccggatcagtgagaacgattgccggtacatttacaatgcatcaagagcttgagaaaaagctggcagcctttaaaaaaacggaggcggcacttgtattccaatcaggcttcacaacaaaccaaggcgtactttcaagtattctatcaaaagaggacattgtcatctcagatgaattgaaccatgcctctattattgacggaattcgactgacaaaggcggataaaaaggtgtatcagcacgtcaatatgagtgatttagagcgggtgctgagaaagtcaatgaattatcggatgcgtctgattgtgacagacggcgtattttccatggatggcaacatagctcctctgcctgatattgtagagctcgctgagaaatatgacgcatttgtgatggtggatgacgcccatgcatccggagtacttggcgaaaacggcaggggaacggtgaatcacttcggtcttgacggcagagtgcatattcaggtcggaacattaagcaaggcaatcggagtgctcggcggctacgctgcaggttcaaaggtgctgatcgattatttgcgccataaaggccgtccatttttattcagcacatctcatccgccggctgtcactgcagcttgtatggaagcgatcgatgtcttacttgaagagccggagcatatggagcgcttgtgggagaatactgcctattttaaagcaatgcttgtgaaaatgggtttgaaactcacagagagtcaaacgccgattcttcctattttaataggtgatgaaggtgtggcaaagcaattttcagatcagctcctttctcacggtgtttttgcccaaagtatcgttttcccgactgtagcaaagggaaaagccagaattcgcacgattataacagcagagcacaccaaagatgaactggatcaggcgcttgatgtcatcgaaaagacggcaaaggagctccagctattgtaacaagaggaagagtttactcttcctcttttgattccttattgattattattctcaatgagtgtacaatgataggttgccagttgtgcagagcttcaataacctttatactgaagggtggaagtttggtttgaaaggagaaaatatgacatgaatgaaaaacaaaaattagagagcggacaagttaatccatcggacaaaaaatccgagaaggattacagcaagtactttgaagctgtttacattccgccttctttaaaagacgcgaaaaaacgaggcaaggaagccgttacttatcataatgactttaaaatttctgaacaatttaaaggattgggagacggaagaaagttctatatccgtacgtacggctgccaaatgaatgaacacgatacagaggttatggcagggatctttatggcgctcggttacgaagcgacaaactctgttgacgatgccaatgtcattttgttaaatacatgtgcaatccgtgaaaatgctgaaaacaaggtgtttggtgagctcgggcacttaaaagcactgaaaaaaaacaatcccgatctgattttaggcgtgtgcggctgtatgtcccaagaggaatcagtcgtgaaccgtattttgaaaaaacatccgtttgtcgatatgattttcggaacgcataacattcatcgcctgccggagcttttgtcagaagcatacctttcaaaagaaatggttgtagaagtttggtctaaggaaggggacgttattgaaaaccttccgaaagtccgaaatggaaaaattaagggctgggtcaatatcatgtacggctgtgacaaattctgtacgtattgcattgtgccttacacacgcgggaaagaaagaagccgtcgccctgaagatatcattcaggaagtgagaaggctcgcaagtgaaggctataaggaaattacactgttaggccaaaatgtaaacgcgtatggaaaagactttgaagatatgacgtacggacttggtgatttgatggatgaactgagaaaaatcgatatcccgagaatccgttttacaacgagtcatccgcgcgactttgacgaccgcctcattgaagtgctggcaaaaggcggaaatctgcttgatcacattcatcttccggttcaatcaggaagctcagaagttctgaagctgatggcccgcaaatatgacagagagcgttacatggagctggtgcgaaaaattaaagaagcaatgccaaacgcttcattgacaacggacattatcgtcggatttccaaatgaaacggacgaacagtttgaagaaacgctttctctataccgtgaagtggagtttgacagcgcctatacgttcatttactctccgcgtgagggcactccggctgctaagatgaaagataatgtaccgatgcgtgtgaaaaaagaacgcctgcagcgtctgaacgcgctggtgaatgaaatttctgctaaaaaaatgaaggaatacgaaggcaaggttgtcgaagtattagttgagggtgaaagcaaaaataaccctgatattcttgccggctatacggaaaaaagcaagcttgtcaatttcaaagggccgaaggaagccatcggcaaaatcgtccgcgtgaaaatccagcaagcgaaaacatggtcgcttgacggagaaatggtaggagaagcaatcgaggtgaaataagatgacgctctactcaaaaaaagacattgtgcagcaggcacgaaaccttgcaaaaatgatctctgaaacagaagaggttgattttttcaaacgggctgaagcgcaaatcaatgagaatgacaaagtgtccacaattgttaatcagattaaagccctgcaaaagcaggctgtcaatctgaagcattatgaaaagcatgaagcgctcaaacaagtagaagcaaaaattgacgcgctgcaagaagagcttgaagagattcctgttatccaggaattcagagactcgcagatggaagtaaatgacctactgcagctcgttgcacacaccatttctaaccaagtcacaaatgaaatcatcacatcaaccggaggcgacctgctgaaaggggaaaccggttcaaaggtgaagcattcaaataacagctgttctctctaaacacggtgcctaaacaggcccgtgtttttttatcatttgtgcggttaaaatgaactaaataatctatgtaccaaatgttcaattggtttttctgtgctcagccgcgtataaactttatcgcacttataagtaaagtttctaggcacccctgcatacaatggaacagaaactttgtatttttatattttatttataaaaatgcacactagacaaatgcccagcataagataacacgaagaagaacaaggaggcatgccggaatgtctgaatacagggaaattattacgaaggcagtagtagcgaaaggccgaaaattcacccaatgcaccaacaccatctcgcctgagaaaaaaccgagcagcattttgggtggttggattattaaccacaagtatgacgctgaaaaaattggaaaaacggtagagattgaagggtattatgatataaacgtatggtactcttacgcggacaacacaaagacagaggttgtcacagaacgggtaaaatacgtagatgtcattaaactcagatacagagacaataattacttagatgatgagcatgaagtgattgccaaagtgcttcagcagccaaactgccttgaagtgaccatttcgccgaatggaaataaaatcgttgtgcaggcagaaagagaatttttggcggaagtggtaggggaaacaaaggtagttgttgaggtcaatcctgactgggaagaggatgacgaggaagattgggaagatgagcttgatgaagagcttgaagacatcaacccggagtttttagtgggagatcctgaagaataaaaaagggactaggggagacagtacccccaagtctcttttttatattgatatatcattcttttatcactttttgtttatgttataatgaaggttggaaaatagaaacgttgatacatagtgagggattaaacaatggccggttatacgcctatgatacagcaatatttaaaaataaaggcagagcaccaggatgcctttttattttttcgcctgggtgatttttatgaaatgttttttgaggacgccaaaaaagcgtcacaagagctggaaattacgttaacgagcagagacggcggtgcggctgaaaaaataccgatgtgcggtgtgccgtatcattctgcttccgcgtatatcgaacagcttattaaaaaaggatacaaagtggcgatctgtgaacagacggaagatccgaaagccgcaaagggcgttgtgaaaagagaagtagttcagctgattacgcccggaactgtaatggacggcaaaggcatccatgagtcggaaaataattttatcgcatctgtttcagcctgctcgaacggatacggacttgcgctgtctgatttaacaacgggagaaaatttggctgttttgattgaacggcttgaagacgtcatatcagaaatttattcagtcggcgcacgggaaatcgtggtttcaggaagcttggatgccgatacagtggcacagctgagagagcggtgcggtgcaacgatttcaattgaagacggagaaacagacgaacacgtaacgatcattgagcacttaaataatgaagatataacaaaaacatttctgcgcttatatacgtatttgaaaagaacccaaaagcgcagccttgatcatcttcagcccgtgcaggtgtatgagcttgaggaagcgatgaaaattgacttgtactcaaagcgtaatctggagctgaccgaaacgattcgttcgaaaaataaaaaaggctcccttttgtggctgctggatgaaacaaaaacggcaatgggaggccggctgcttaaacagtggattgaccggccgcttatcagagtcaatcaaatcgaagagcgccaagaaatggtggaaacattaatgtcccatttctttgaacgggaagatctgcgtgaacgtttaaaagaagtatatgacttagaacgccttgccggccgcgttgcattcggaaatgtcaatgcccgggatttgattcagctgaaggaatcgttaaagcaagtgcctggcatcaaacagctggttgcttcactggctcatgacaaggccaaggaacgtgcaaagcgcattgacccttgcggggatgtacttgaactgctggaagaagcgctgtacgaaaaccctcctttatcggtaaaagaagggaacctgattaaagatggttataatcaaaagcttgatgaatatcgtgatgcaagcagaaacggaaaagactggattgcccgcctggaacagcaggagcgggaatacacaggcattcgctctttaaaggtcggctttaataaagttttcggttattacattgaagtgacaaaagcaaacttgcatttgcttgaggaagggcgttatgagcggaagcagacgttaaccaatgcagagcgctacattacacctgaattaaaagaaaaagaagcgctcattttagaggcggaaaataacatctgtgagctggagtacgagctgtttaccgagctgcgcgagaaagtgaagcagtatattccgcggctgcagcagcttgcaaaacagatgagcgagctggacgcactgcaatgctttgcgacaatcagtgaaaatcgccactacacgaaaccagagttctctaaagatgaagtcgaagtgattgaaggcagacacccggttgttgaaaaagtcatggacagccaggaatatgtcccgaacaactgtatgatgggcgataacagacaaatgcttctcattacaggtccaaacatgtcagggaaaagcacgtatatgagacaaatcgcgctcatttccattatggcgcaaatcggctgctttgtacccgcgaaaaaagcggtgcttccgattttcgatcaaatttttacgcgaatcggcgctgcagatgatttgatttccggacaaagtacatttatggtagaaatgcttgaagcgaaaaatgcgattgtcaacgcgacgaaaaacagcctcattctgtttgatgaaatcgggcggggaacgtccacttatgacggcatggcgctggcacaggcgattattgaatatgttcacgatcacatcggcgccaagacgctgttcagcacacactatcacgagctgaccgttcttgaggacaagctgccccagctgaaaaacgttcatgttcgcgctgaagaatataacggaacggttgtctttcttcatcaaatcaaagaaggtgccgctgataaaagctatggtatccatgtagctcagcttgccgaactgccgggagatctgattgcccgcgcccaagatattttaaaagagcttgagcattcaggaaacaaaccggaagtgccggtgcagaaacctcaggtgaaagaagagccggcacagctgtccttttttgacgaagcggaaaagccggctgaaacaccaaagctttcaaaaaaagaaaagcaagtgatcgatgctttcaaatcacttaatatactggatatgacaccgcttgaagcgatgaatgaaatgtacaagctgcaaaagaaattacattaaaacggggtgatgaatgtggcaaaagtcatccagctgtcagatgagctttcaaataaaatagcggcgggcgaggttgtggaacggcccgcctcagtcgtcaaagaattggtggaaaatgcgatcgacgctgacagcacagtcattgaaatcgatattgaggaagcaggccttgcatccattcgggtcttggataacggcgaaggaatggagaatgaagattccaagcgagctttccgccgccacgcaacgagtaaaataaaagatgaaaatgatttattcagggtgagaacgctcggtttcaggggagaagccctgccgagtatcgcgtcagtctctcatctggagattacaacaagcactggtgaaggagctgggacgaagctcgtcctccaaggaggaaacatcatttccgaatcgcgttcctcaagcaggaagggaactgaaattgtcgtttccaacctgttttttaacacaccggcccgtttgaaatatatgaaaaccgttcatacagagcttggaaacattacagacgtggttaaccgtattgctctggcgcatccagaggtatcgatccgcctgcgccatcatgggaaaaacctgcttcaaacgaacggaaacggagatgtgcgccatgtactggcagcgatttacggcacggctgtcgccaaaaaaatgcttccgctgcatgtgagctccttggattttgaagtaaagggatatatcgctctcccagagattacacgggcgtcgagaaactatatgtcgtctgtggtcaatggccgttacattaaaaatttcccgctcgtcaaagcggttcatgaaggctatcatacgcttctgccgatcggacgccatccgattacttttatagaaattacgatggacccgattttagtcgatgtcaatgtgcatccatcgaagcttgaggtccggctcagcaaagaaacagagcttcatgacttaattcgtgacggaattaaagatgtatttaaacagcagcagctgattccgagtgcccagcttccgaaaaaatcggcacctgttatcaaaaatgagcagcagttcataacctttgatgaaaagcctccggaaagaaaagtaccggaaaaagcgcatgcgccatcttattcaccaatgaagctcagctcagtcgtgaaagagccggttgatacggaggaagaattgcctcctcaccaatttgatgctcctcctatcgttgatcaggaacaaacccttgaggtgtccgatgtttcagaagaactgcctgaaacatttgagcaggaatgccatgaggaacagcagcagccagcgtctgagcgggttccgattatgtacccgatcggccagatgcacgggacttatatattggcacaaaacgaaaacggcctgtatattatcgaccagcacgccgcccaagaacgtattaaatatgagtactttcgtgataaggtgggggaggttgagcctgaggtgcaggatatgattgtaccgctgacgttccactactccacaaatgaggctttgattattgaacagcacaaacaagagctcgaaagcgtcggtgtctttttagagtcattcggctccaacagttacatcgtccgctgccacccggcctggtttccaaagggagaagaagcagagcttatagaagaaatcattcagcaggtgctcgactccaaaaatatagatattaaaaaactccgcgaggaagcggcgattatgatgagctgcaaaggctccatcaaagcaaatcgccacctcagaaacgatgaaatcaaagcgcttctggacgacctccgaagcacatcagacccatttacatgcccgcacggccgcccgatcatcattcaccactcgacatatgagatggaaaagatgttcaaacgcgtgatgtagcgggggtggtaagcattgatccattctctgaatggatcaatgctttttttgtactccttcgagtgtcagattataagaaacggttgtaaacgtgtgagcagtgttaacgcattatacttcatggtttctccgtataacaaaatttccatttacaggcaattgggattaatgtatattttgggtgagggggtggaaacatatggcatgtggtcagaagatcattatctttttggatgaacttgatgatccaaatgtaagaatcattttagaatgcagaatttaaattacaacattgtgttttgctccctgttcgtgtgaacagggagattttttcgtttatataactggtgatgtccaaatatagggtgttatgaattttccatatctgccatcggctttaagctgcttctctattaggctggttatcaaaagcaagttcaatgaaagccatgaaagctgatatcacaacaagcaagatatctggaatataaatagactgcataaagtaatctgcaaaacaaattgttataagattgctgataaaatacagtataaaagcaaaaagtgcagtctttttcaatgaaagtgattttgccaaaatgatagagagaatctttgtgagtgggtctatgattaaacctacagcaaagcaggctaaaataaataaagctaatgtttgattggaagcgtatgtgatgccaagtatggagaataagcctttcatcccgaagaaaaagccgccgaagatgactgcaagcgcaatggccgcgataaaagtgatagatacaattccgattaattttgatctcaggttaaaatctttagagtgctcgttctgttctttttggttcaagtatgacactcccttcccctgcttactcatacaaacagcacccttgaatcagcccaaaatatctataagtctgttttctgacgaaaatagtatagcatattttaacaaaaccaaaaaaggccctttccactggggaagggcctttttcatcatgttaactcctgagattcgccgaagctttctctttttttggccaaataaaatagctggctgtaatgagaaagtcaatgcctataatgacagtccacagtttaagaatgccgctcaatgcctcggttcgggcagagtcattgataaaatagatcatccctcccaatagtcccgcaccaattaagtaggccagcacatgtcttagccagcctttcgcaccgtgcttggcatggtccattccaaaacgtttcagcggttttgcgcctttttttgtcacataatattgaaatttttcatctgcccattgaatcatttgttttccataagcgatcgatataccgatgtaaacagctgcaatcccatgggctgcggtcgctgaggctccgcggtaaaggtccacaccagttgccgctaacaagatcaaatcgataactggagttaaggcaaggaatagcagtcctaatgtatgtcgtttgaatacgtagcgtacagcaagccccaaaacaatgacaacccaaaacgcaatttcacagaaaacaatcatccatgcgataccgttcaatccattcccctcttttcaatacagttgtattatttaaataatatgttaccatctttgtttttgtaacacaactgtattataaaaattgctctctcatttttttcttgttacaataaagctatgccaaaacaaattgaccatgagaaaagaagaaaacaaattgcagaagcaacgtggcgtgtcattttagaacgagggatggagggagcatcagccaggaacattgcaaaggaagcaggattgtcattaggtgcgctgcgccattatttctctacacaggatgaattgcttgcttttgcaatgaaacttgtccaagaaaaggtgacggaccgaattaaggacattgcagtgagggatttgctccctaagaaaaaagtgttgcaaattttgcttgaaatggtcccaacgaatgaagaaacgattagagagatggaggtttggtttgcttttactgcttacgccagacataaaaaggatatgtttgatgcgaatcatgacgggattttcagcggcatgcggaatctgattgcctatttagatgaatccgatttactgaagcagaatgctgataaagacattgaagctgagagactttacgcgcttgttgacggcttggctttacatgccatgcttgaccccgtgcgcgtgaataaagaccgaatcaagcgggtcattatgcagcatgtagagtcaatttgcgtggaagatacacgtgagacagaagagaaggaataatgataaatctgtataaaaacggttcaataaagtgccttgatctatttactaagtgttactggatagctcgatataaagcagcgcctttgaacgaaagctcaaaggcgctacgctgtattattttgatgaaagtgactgtcagctgtgctggatatcaattgtatatactgcacgatctgttacgaccttcaacccttcgttttcttggtgaatatgaatgtcacctaataaaggaatctcataggcattttgcggaagcggtacgtttccgtcctcagtgaatgttgttccttcgccttctaaaacgagctcttctttcgcaacataatcatcaggatgattcgtactgcgtatagccactttttgaaggtggagaacaatctgatccaagtctgatatctcttcatcatgggtcaattcaccttttctaatatcaagcgtctggccgacttttgattccagccattgagaaagctgtgtattcgtgtgtgccatcaatattcctccttttgatttacacgatactattcccaattgctgcatcttttacacggaaaagagccgcctcactctttatgtatgaaacaattcgctgttgagagccttgatatagcgtacggcagaacgctggaccgcttcactggcattttctttgacaactttagaaaaagcattgtaaagccggttgaattgaagcggttttactttggctgctatttcttcaactttggaggcgggaaggggaatgagatttgggtagctgtacataaagctgacccagtttcggtccgccgcaaccgtaatgatatctccggtcaatagacaccctttcccttcattgcccttgctccaatgcaaaacagcaccgcctttaaaatgtccgcctagtcggtaaaggtccagtcccggctttacgttgagcgtttcccctgaccagaagtgaatgtgattgcttggccttgtcacccattctttatcatcctcatggatatagatcggcgcctgaaacgcttcagcccactcaacctgagtagagtaataatgcggatgagacaaggcgatggcttgaataccgcctaattcgttgatttggtcaattgtcttttggtcaagatatgtcatgcaatcccacagcacattgaagcccttatgctggataagatgggctgtttgtccaatcgcaaactctggttcagttttgatgctgtaaagatgctcttcttccttttggaggatgttttgaaggtttcctttctcacgcatgtcttcaagagttgtccaagtttgtccatcgggatgaatatactgcctttcatcctcgcaaatcagacacgagttgggcggatctacagtctgtgcatgttgcacaccgcatgtattgcagatataatatggcactttcttcacttccttcatctattttccattattttaccttatgattatgaatattcaaacgaaaaaaccggcagttctgctgagagagaattgccggctttttggtgctttttattggccggggacggaattttctgcgttgacagcgcccgctccgtagatattcggatcttcatctttccatttgtccgtgccgtttttcaaaagctcttttacttcatcgggggtaagatccgggttttgctgaagaattaaagctgcgattcctgcgcaaatcggtgttgccatcgaggttcctgacattgtaaagtactgagaccctacacggcttgacttttggagcttatcaatataagaattcggagagcgaagggaaataatattaacacccggcgctaaaatatcaggcttttctttcccgtatactgtcgggccgcggcttgagaaggaagcgacagtatcatcatcgctgcttgcagtattgttatcgtcaagcgcacctactgtaatcaccttttcgctcacgcccgggcttgcaatggtctgcgaatcagggcctgagtttccggcagcgacacagacgacaatccctgcgctccacgcttcctcaaccgctctgactaacggatcttcctgttcatgatcatatctaagggcatcgcccccgagcgacatgctaataatatcaatcggttcatcggggttgtcctcattgtattgaatacaccactcaacaccctctataatatctgctaacgttcctgaaccctgcttgtttaatacctttacgccgatgagattggcttccggtgcagggccgcggtattgaccggaagaggatgcgccgctgcttgcgacatcacctgcacagtgtgtgccatgaccattgtcatcgtacggctctgttttttgattgaccatgtccgcgaatccgataattctgccttctagatcaggatgcgggtagattcctgtatcgacaacagcgacagtaacaccttttcctgtcagggtttgcccgtttctgacgacttccttcgcatggcttgcttcggttgccgtgtctaaaagcgctttgacttcgcggtttaaatacactttacggatattgctgcattcagagagaagggaatgtaatgctgaaggagtaacctcggcgctgcagcagttgattttgttgaagcggctttttagcttgctgcgtttttctttttgcagcacctctccagccatttgaaagccggtctcgtgacagccttcctcaaattcgataatgactgacattttttttctgttttgcaatttggtttcgaaaaatttatgcaagaagcaaggagtccatttgaagggcttgtaaagctgcaatacggtttcccgtaacggccaatctagcttgtgagcatttgctctcaccatttgtaccatagagtacccaaacatgtattttcctcctattataaggttctctgtatactctatgaacagatgataggtttggtaagtttgtttgtcctctgtaagagacagacaagagtttgtttttctgaatctttcgcattagatacgatagattcagaagttaggaaatcattggggattgaaaaagaacgtttgttcgtattataatgtggtcatatcaaactgggaaggggagagcaaccgtatgaatttctacttgcaccgttctttggaaagccaaatgccaatcagcattatatatatgaagaaagacggaacgattagtaaaagaacgattattgtgagacagaaaagcaaaacgaaaatcaaagcattttgtttttcgaaacaacagatcagaacatttttattggactctatcctctcctgtgattttgtgagaacaaataagcaaaatctctattctgcaggacggtaacagctgtccgtctcagcaaccgggcagcctgttactaaaaccctccttaaacctatatacatttatttgccaagtgaggttgttcctacctttttttgtctttcctctcaaccttttttcactcttatttgaaatgaaccgctaataaccgtgacaatcaattgattttttgaaaccgggaactttttcactgatgatattgtgtatacaatggtaagataaaacctattggctaaacctcatataatgaaccgcgccattcttatgaaaggagttaaacatgagaagatttttactaaatgtcatattagtcttagccattgtcttgttcttgagatatgttcattactcattggaaccagaaccatcaaatcagccagatacatattcaaatttcagcagcttggcagagaatgagagcccagccgattacgatatttcatataatgagaaaaaaggaagcaaagtcttaattatgtctccgcatggcggaagaattgaaggcggagtaagtgagcttgttcgttatttcaataatgaatactctacatacctgtttgaagggttgaagtcccacgataaccaaacgctgcacattacaagcaccaactttgatgagccattggcaaaaaagaaaatcaaggagcatcaatatgtggtggcttttcacggatataaaggggagaacaagaatacccttgtagggggaacagaccgaaagcgggcgaaaatgattgtgagagcccttgagcggagagggttttccgctgagttagcgtcgtctaaaagcggtcttgctggattgaatgccgaaaacattaataaccaaggggaaacggggctaagtatccagctggaaatcagccgtgagcagagagaagcattttttgatgatttttattataaaaatagaaaatacacaaagaacagtgaattttatgcttatgtcagtgcgatcaaaggtgtcctggaaaaagagtattcgtaacaagcagatcagaagacaaaataagagaagatcagtagactgaaataggataaaaaaggaggcaaaacaatggcagatcatcatttttatttaaaagcgaattggccgggtaaccgcaatgatgtcggtacgatcgaaagcggaaacctgatcacatcgatttccattcctaaagaaatggatggcccgggagaagggaccaacccagatgaaatgcttctcggggcggcagcgacctgttacattattacacttgcagcgatgatggagagaagcgggctggaaaaagaagacttacagatggagtcagaaggcattgtcgacgtcacaaaaggagtctttacatacaaaaagatcattcaccgtccctctgtcgtgcttaaacatgatgcttcacaagacgacgtcgcattggcgcacaagctttgtaaaaaagcggagtcgtcatgcatgatttcgcgtgcaattcaaggaaatgtcgagctgcagcttgaagcctctgtgaaactgggtggagaataaagaaaacagacggtcactcacaggccgtctgttttttatcatcagcgtgggctttcgattgatttagcacgaccacgcctgcaatgacaagcgtgagaccgaatacaccttttaaactgatggtttcgccaaaaagcaaaaacccgacaattgctgtaagtgcggtaccaacgcccgaccatgttgcatacgcgcttgataagtcaattgtttttaaagaaaagcttagaaacgtaaaagcagaaagaaatccgactatgactccggcaatgggccaggcttgtgtaaatccttctgaaagcttcagcatcgtgctcccaaacacttcagatacaatggcgagagccaaataaagcaatcctctcatcttcatcactcctttactgccaattaagtaacacgacccctgatagtaataaaagaatcccgataagccctttggcattcagatcttccttgaaccattttactccgatcactgtcgtcagcaccgtgcccgccccgctccaagtcgcataggagaggctcaggggaatatggtttaaagtcagggacagcatataaaaggcgagggaatagccaataacgaccaaagcacttggcttccactttttgaagccatcagatacttttagcatggctgctcctatcgattccgaacatatggcaatcgtgaggaatatatatcctatcaacatcatgaattctcctcactatatttttagattagaaaaaacttcagctagaaaaatattagtgtatgcctatgtatgagtcaagagattcattttcacacacttaaaaagacccctttttaaggggtcttttgcgtttaataataaaaagggaacggggcatacggataataggggtatccgccatacaaataaggattaaataaagcgcttcctataagcccgcctgcaaggccgccgataaacggtcctccaaaaaatccgaatggccggccaaacccataaccaaatccgggtcttccaaacccgtaaccgaacccgaacggtcttccaaacccaaatggtctcccgaatccgaacggccttccaaatattcttgtatcttcagggctgaaatgctctaactcgttcatgttttctttcctcctgtaataaagtgtagatgatgcagtgtattcaccctgcccggatttgattgggcgaatcgaggaaaaggaggatgtgaacacattgggcctgtatcagtctgactggtcaaaagcaccgccccacgcacatgcttatcatgtcaaaacaacgagagaacagggccattatcatctcatcgaagggtttactcagccggcaaacggatcaaataccgatcagcatacacattactatacagggatcacttcatttgaaaacggccattttcatcggtattacggaatctcaggaccggcgattcccttagcagatggcacacattatcatgaaatcgaagaaacgacgtatctggcctataacgagccgattgagatccagtacggaggggttgtgtacgatcccggagatgacagaagaaaaacgcatcgtcataccctgaaaggaaagacaagggaaattgtcggcaatgagccgctcggctggtagaaggatgtttaccgatgcaaaaaaagggcaaaatggataggtggttgtccatgttgaatgctataatggggggagatttataaaagagagtgatacatattgaataatacgaagcagcccgttgtcattttagtcggaccgacggcagtggggaaaaccaatttaagtattcagctagccaaatccttaaacgcggaaattatcagcggagattcgatgcagatttataaagggatggatattggaacagctaaaattaccgaacaggagatggagggagtgccccatcatctgattgacattttagatccccaagactctttctctactgccgattatcaaagcttagtaagaaataaaatcagcgagattgcaaatagaggaaagcttccgatgattgtcggcggtacagggctttatatacaatctgtgctttacgattatacatttacggaagaggcaaatgatcccgtgtttcgagagagcatgcaaatggctgctgagcgggaaggcgctgactttcttcatgccaaacttgctgcagcagatcccgaggcagcagctgcgattcatccgaataatacaagaagagtcattcgcgcactggaaattttacatacgtccggaaaaacgatgtcccagcatttgaaggaacaaaaacgagaacttctgtacaatgcagtgttaattggcctgacaatggatagagacacgctttacgaaagaattaatcagcgggtcgatatgatgatgcagtcaggccttcttccggaagtgaaacgcttatacgacaagaacgtgagagactgtcaatcaatacaggcgataggctataaagagctgtatgcatattttgacggttttgtgacactttccgatgctgtcgaacagctaaagcagaactcgaggcggtatgcgaaacgccagttgacgtggtttcgcaacaaaatgcaggtcacatggttcgatatgacaccgcctgttgatatggagctgaaaaaaaaggaaattttcacacatatagcaggaaaactcgaactttaatcgaaactgtatgatatagagaatcaaggaggacgaaacatgaaaccgattaatattcaggatcagtttttgaatcaaatccggaaagaaaatacgtatgtcactgtttttttgctgaacggctttcagttgcggggccaggtgaaaggctttgataactttaccgtattgttggaatcggaaggtaagcagcagcttatatataaacatgcgatctcaacgtttgcgccgcaaaaaaacgtccagcttgaactcgaatagatcaaaaaatgccatgtcaagacatgaggaaaggctgccgggggttcccggcggccatttttaacattcatccacttttgctccaagcttttttttgtaagctgaccatgccaaggcatggtctttttttatgagaacaacatacggaagtaaaaatggtatattatgtataaaatgaatttgggggtgatcgaccttgtttgaaagtgaagcagaactgagacgaatcaggattgcacttgtatggatagctgtctttttactgttcggggcgtgcgggaatcaagataccattattgaaacagacagcggcaattcagactatgaaacgcctcagcccacctcgtttccacttgaacataaccattttggcgtgatggaggacggctatatcaaaatttatgagtataatgagtcccgcaatgaggtaaagctgaagaaagaatacgcggatgatgagcttgaataaaattcacaagcattcgaatttacaaagcggatgccagccgctaaactaaatacagacacagatcaaacagagggtgaaaacatgaagcataaagtgatcgtgaatcattgggaagaaatttgcgaagatgattcttgctatgaatacggaacaagtatcattgtgaacggaaaagaattaatcagagaagcctcaattatcactgctttgaaggcggttttagaagagatcggcgcggatgttgaaatagaagaaacagtagagagcgaaaaatgctgtgatagcttaagaaaaaaaaatctagactactaagcagttttttttcatgttatgatatacatcggctaaaaacgacaccccgagtaggacgagagatgattctcgttctgctctcttttttgggccctaatgagtctgcccatttgcctgatttgatcaaaatatgaatttttcataaaaacgaatctatatattgtgtttttgctagagggtagtatactatatatagtgttagtgatgagagattcatatttttgataggtcgtgataaaacgtggtacaaatcatatttgattcgaaaacagggaatgttcagcggtttgtgaataaaacaggctttcagcagatacgcaaggtggacgaaatggaccacgtggacactccgtttgttttggtcacctacacgacaaacttcggccaggtaccggcatcaacacaatcatttctcgaaaaatacgcccatctcttattaggagtcgctgcgagcggcaacaaagtatggggcgataactttgcaaaaagcgccgataccatttcaagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaaaaagatgggaaattccagtttgataaggataaagaggctgtacatagctattttgtagattatatcaatcaaaacacagtcttctttcacgatttaaaagagaagctggattatttggttgaaaatcaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgctaacggcgacactgagaaagcaaaagaatatgtaaacctgatgatcaatcaagaatatcagccgagcacaccgacatttttgaatgccggcagaaaacgccgcggtgaacttgtgagctgcttcttgctggaagttaatgattccttaaatgacatttcaagagcgatcgatatctccatgcagctttctaagcttggcggcggggtttctcttaacctgtccaagcttcgcgcgaaaggtgaagccattaaagatgttgagaatgcgacaaaaggcgttgtaggtgtcatgaagcttcttgataacgcgttccgttacgctgaccaaatgggacaaagacaagggtccggcgcggcgtatttaaacattttccaccgcgatatcaatgattttcttgatacgaaaaagatttctgcggatgaagatgtgcgtgtcaaaacgctttcgatcggtgttgtcattccggataagttcgttgagcttgcacgcgaggacaaagcggcttatgtattctacccgcacacgatttataaagagtacggccagcacatggatgagatggacatgaacgaaatgtacgacaagtttgtcgacaaccctcgggtgaaaaaggaaaaaatcaacccgcggaaactgcttgaaaaattggcgatgcttcgttctgaatcaggctatccatacatcatgttccaagataacgtgaataaagtgcatgcgaataaccatatttccaaggtcaaattttctaacctttgctctgaagtgctgcaggcatctcaagtttcttcatacacagactatgatgaagaagatgaaatcggtctggatatttcctgcaacttgggttcgcttaacattctcaatgtcatggagcataaatcaatcgaaaagacagtcaagcttgcgacagactctttaacacacgtgtctgaaacaactgacatccgtaatgcgcctgctgtaagacgggcaaacaaagcgatgaaatcaatcggcctcggtgctatgaaccttcacggctaccttgcgcaaaacggcattgcgtatgaaagtccggaagcgcgtgactttgcaaacacgttctttatgatggtgaacttctactccatccagcgttctgcggaaatcgcaaaagagaagggcgaaacgtttgatcaatatgaaggctcaacctatgcgacaggtgaatactttgacaaatacgtttctactgatttctcaccgaaatacgaaaaaatcgccaacctgtttgagggtatgcatatcccgacgacagaggactgggaaaagctaaaagcatttgtcgctgaacacggtatgtatcacagctacagattatgcattgcgccgacaggctctatctcatacgttcaatcaagtacggcgtctgttatgccgattatggaacgcattgaagaacgaacatacggcaactcaaaaacgtactacccaatgcctgggcttgcatctaataactggttcttctataaagaagcctacgatatggacatgttcaaggttgtggatatgatcgccactatccagcagcacattgatcagggaatcagctttacattgttcttaaaagacacaatgacgacccgtgatttaaaccgaatcgatctgtatgcacatcatagaggaattaaaaccatttactatgcaagaacgaaagatactgggcaagacagctgcctttcttgtgttgtttgattaaaggagagtttatagtgacaaaaatttatgacgcagcaaactggtcaaagcatgaagacgattttacccaaatgttctataaccaaaacgtgaaacagttctggcttccggaagagattgctttaaacggcgatctcctcacatggaagtacctcggaaaaaatgagcaggacacttatatgaaggtactggccggacttacgcttcttgatacagagcaggggaatacggggatgccgattgtggctgaacacgtagatggccaccagcggaaagcggtgctgaactttatggcgatgatggagaacgctgtccatgcgaagtcgtactctaatattttcatgacccttgcaccgactgaaacgattaatgaagtatttgaatgggttaaacaaaataaatatttgcagaaaaaagcgcaaatgattgtcgggctttacaaagccattcaaaaagatgatgaaatttcactgttcaaagcgatggttgcttccgtctatctggaaagcttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgatcgaccttctgaatcagttatatgaaaatgagcttgagtatacagaggacttgtacgatcaagtcggactctcacacgatgtaaagaaattcatccgctataatgcgaataaagcgctgatgaatcttggatttgatccatacttcgaagaggaagatattaatccgatcgtattaaacggattaaacacaaaaacaaaatcgcatgacttcttctctatgaaggggaatggttataaaaaagcgacagttgagccgctcaaagatgatgacttttattttgaagatgaaaaagagcagatataatatctgctcttttcggcttgaaggttcaaatgaggaggacgcagtacccatgggaaaaatggacgaaatgattttagttgccccgcgcgatgatgtgtttaaaaaagaaagcttaaccttccagggcgtgtacagtgaagatagcagagtagcagaaatcatggctcagattgaagcggcctatcgtgaaatgagaagaggggacgcagaagaagatccgcgtttcaagcagccgataccttatgtcgtcattaagcgtgaagatgaagtttttctttacgagcggctggctggcggcggtgaatcacgtctgcacaacaagctttctctcggttttggcggccatatgaacgccatcgaaggggcagcttcatttgctgaagtcttaaagctgaacacagaccgtgagcttgaggaagaactgcaaataaatgaagaagataaacaggcgattgtcacactgggattgatcaatgatgatgaaaacagtgttggcaaagtgcatatcggtattctttctgcgcttcaattaaagcctggcgcacaagtggaagtgaaggagaaagaacaaattgcgggtaaatggatgaaagtttctgaattaaaacaggatgacatctacaaccgtctggaaacatggtcacagtttgttgttgatattcttgaataaaaaaacccggtttctcgcgatgaggagccgggtttttttatgagacgctcgtccccgtctcggctatgattctaggatcacaatagcgtcaaagccggcatttttcgctctggcagcgagagtgtctgcattgtcattggatgaaaatgcgccaatctgcactttgtaaaatccgtcctttaaaaggacaatcgagtcaaaacctttggcttcggcattacttgcgagcgagtcggcattcgctttgactttaaatgcgccgatttgaaccttatataaccctgagctggaagtctttttaaggttaaaggcttgctccagcccgtttgcatgtcctctcgctaagctttgaataaaactgctcgttttcagcttatttgcatcggaaacggtatcaatgaagccgttctcggtcaagagggcaggcattgccgactcccttaggacgtggaagttcgctgtttttttgccgcgatcggcaaagtcgacagcttgtatcacttcagagtgaattgccgattgataagtcgtcgtcggggctcctacatctggataaatatagctttcaaaacctgtgcctcccccggaattaacgtgaatggacaaaaagaaatctgctccccagttatttgcggcatttgtccggtcgtttaagctgacatattggtcgcttgtccggctcagcagcagagaaacgccttcatattcattagttaatatcgtacgtaaggctaaagcgatttgcagggttaacgttttttcctgaaggccattacctgttgcgcctggatcagacccgccatggccaggatcaataaaaattttaaccatttttcatcacctcattacaggatatgaaaaaacacagcttctgcttgtacgattatcattcaactgaaaaatgaggaaataaccctttcacatccagaaattatttctcgggaaagcgcacaattcaacatgaagcgacaacagatacggtccgacatgaaatctgtgcatacgccatatgtttgtatgtactttgagttcggttaacctgcactgattcctgttggttttaagctttgcgttcatattaaatcaagcatttgaaacgtaaattgatgagaaaagctcctttcattaaagacaccactttataaatcgaaaaaaagaaaaacacttcaggtatcttagggcgggtaatacgcttcgtacaaaaaacagcccgttgcatgaaaaaaggattggcgaatggagaaaataatgagaaagaagctcactataatactttgacaaaatgattaaaaacaaaatctcatggtttgtccaccccatgtccgtgaatacaataagaaataaagtatttctcgggaaagcgcaggattccttattgttcccgaaaaaagcaattgtttcgacacatgataggcgtttgtcacaatcggcatccgcttgaatatcatatagagagaacagagaggtgaagatgttggagcgcgctgtgacttataaaaacaacggacagatcaacattattctgaacgggcaaaagcaggtgctgacgaatgctgaggcagaggcggaatatcaggctgcattgcaaaaaaacgaagcaaagcacggcattttgaaggaaatcgaaaaagagatgagcgcattagttgggatggaggaaatgaaacgcaacatcaaggaaatatacgcctggatttttgtgaaccaaaaacgcgcggagcaaggcttgaaggttggaaagcaagcgctgcacatgatgtttaaaggaaatccgggaacgggaaaaacgacggttgcacggctcatcggcaagctgttctttgaaatgaatgtcctgtcaaaaggccacttaatagaagcggagcgggctgacctggtcggggagtatatcggacacaccgcccaaaagacgagagatttaatcaaaaagtcattaggtggcattttgtttatagacgaagcctactcgctggcaagaggcggcgaaaaggactttgggaaagaagcgatcgacacacttgtaaagcatatggaagacaaacagcatgagtttattttgatactcgccggatattcacgggaaatggatcattttctctcgttaaatcccggactccaatcaagatttcccatctccattgattttccggattactctgtgacccagctcatggagattgcgaaacgaatgatcgatgaaagggaataccagctcagtcaagaagctgaatggaaattgaaagattacttaatgacagtgaaaagcacgacaagtcccattaaattcagcaatggacgttttgtcagaaatgtgatcgaaaaatcgatcagagcacaagccatgaggcttttaatgggagaccaatacttaaaaagcgacttgatgaccatcaaaagccaagatctttccattaaagaagaagcatctggatctgcatagacctctcagtttttgagaggtctgttttttgctcgtatttccgcttttcaaagcaatcgatttgtggtatacacatgcagggtttggtatgataatactactgcccaatatgcaaaagaaaggaacatccatttgaacgaacaagaaacgattcaggagaaagccattttagtcggatgtcagctgccgcatatcacggatgagcattttgaaaattctatggaagagctagcatctctgacaaaaacagcagacggaaaagtactgaccagcgtcacacaaaaacggaacagggctgacgccgctacatatataggaaaagggaaggtagaagagctgaaggcactggtggaagagcttgaagctgatctcctcatctttaatgatgaactgtcgccaagtcagctgaagtcattggcaacagcaattgaagtgaagatgattgaccgtacgcaattgatattagatatttttgcaaagcgggcgagaacgagagaaggcaaacttcaaattgagctggctcagctgcaatatgcactgccgcgtctgacgggacaagggatcaatctctcccggcaaggcggagggattggggcaagaggtcccggggaaacgaaactggaaaccgaccgccgtcatatcagaaatcgcattcatgaaatcaacacacagctttccactgtcattcgtcatagaagccgataccgtgaaagaagaaagaaaaacggtgtgcttcaaattgcgcttgtcggttatacaaacgcagggaaatcaacatggttcaaccgcctgacgagtgctgacagctatgaagaagatctcctgtttgccacgctggacccgatgaccagaaaaatggtcctgccaagcggctacagtgttcttctttcagatacagtaggatttattcaggatcttccgacgacattgattgctgcattccgctcaacgcttgaggaagtaaaagaagcggatttgatcctgcatttaattgattcttcaaatgaggattatgcgggacatgaaaaaacagtgcttcggcttctcgaggagcttgaagcagatgatatcccgatgctgacggcttacaataaacgtgatcaaaaactgcctgattttataccgtccgccggaagggatcacattatggtcagtgcgaaatttgaggacgacgctgcagcctttaaagaagcgattcagcgctatttgcgccaagaactgttaacgtcttttgaagcacatgtgccggcaagtgaagggaagctcctttccagaatcaaatcggaaacgatggtagaccgcttctattttaatgaagaaaatgaacagtatgacatatccggctatgtccaagaagagcaaagtatcatcggtgaattaaagaagtatatgtaggaaggaaatataaagacatgtttgacacattaacacacggagaattattgaagaaaacggcaatggaagtggaagcggacattgccggcgttcataaacaaatagaagaaatcagcgagcgaaatgagtggagagtgcttcaaagctatagaaaacacaaagtaagcgacactcatttcacgccatctactggatacggctatgatgatatcggaagagacacgcttgaaagcatatatgcggatgtgtttggcggagaagcggggcttgtaagaccgcaaatcatttcaggcacacatgccatctcgattgctttgttcggtgtcctaagaccgggggacgaactcctttatataacgggcaagccatatgatacgcttgaggaaattgtgggcgtcaggggtggagaaaacgctggatcattaaaggattttcaaatcggctataatgcggttgatctgacgaaagacggaaagatagactatgatgcagtcgccgctgcgatcaatccgaagacaaaagtaatcggcattcagcgctcaaaaggatatgcgaatcgcccttctttcttaattagtgaaataaaagaaatgatccgttttgtaaaagaaatcaatgaaaacctgatcgtctttgtggacaactgttacggagaatttgtggaagagcttgagccttgccatgtcggagccgatctgatggcgggatctctcattaaaaatcccggcggcggccttgcgaaaacaggcggctacctcgtcggaaaagcgaaatggattgaagcttgctcataccgtatgacgtcacccggcatcggcagagaagcgggggcatctctttactcgctccaagaaatgtaccaaggcttctttttggcgcctcacgttgtgtctcaaagtctaaagggagcggtgtttacagcgagattccttgaaaaactcggcttcacttcaaacccgaaatgggatgcgaaaagaacggatttaatacaatccgttgagttttctgacagagaaaagatgattgctttttgccaggctattcaatttgcatcgccaatcaatgctcatgtgacgccttatccagcctacatgcctggatacgaggatgatgtcattatggcagcagggacgtttattcaaggagcaagcatcgaattatcagctgatggccctatccgcccgccgtatgtagcgtatgttcagggaggattaacctattcgcatgtcaagaatgccatatgcagtgcagtggattcattgatggaaaagcaattaatttaaattttttaaaaatttctctggatttgatgttaagaatccttacatcgtattgacacataatataacatcacctataatgaaactaagttaagaaaaggaggaaattgagatgagtgataatattcgccgctcaatgcctttatttccaataggaattgtcatgcagttaactgagttatcagcaagacaaattcgatattatgaggaaaatggactgatatttccagccagaagtgaagggaatagacgattattttcatttcatgatgtagataaactgttagaaatcaagcacctgatagaacaaggtgtaaacatggcaggaattaaacagattctggcgaaagccgaagctgagctagaacaaaaacaaaacgagaagacgaaaaaaccaatgaaacatgatctgtccgatgacgaactgagacagctcctgaaaaacgagctcatgcaagccggccgttttcaaagagggaatacattccgtcaaggcgacatgtcccgcttctttcattaatccgttagcaactgttttgctatatacatttaccttttaagaggaggaattttaccaaatggcaaagtacactagagaagatatcgaaaaattagtaaaagaagaaaacgtgaagtatatccgtcttcaatttactgacattcttggaacaatcaagaatgttgagattcctgtaagccagcttggaaaagcgcttgataataaagtcatgtttgacggttcttctattgagggattcgttcgtatcgaagagtcagatatgtacctgtatccagatctaaatacatttgttatcttcccatggacagctgaaaaaggtaaagtagcacgtttcatttgtgatatttataatccggatggcacacctttcgaaggtgacccgcgaaacaacttaaaacggattctgaaagaaatggaagacctcggcttcagtgattttaaccttggacctgagcctgaattcttcttattcaaattggacgaaaaaggcgagccaacgcttgaactaaacgacaaaggcggatattttgacttagctccaactgatttaggagaaaactgccgccgcgatatcgtacttgagcttgaagagatgggctttgaaatcgaagcgtctcaccacgaagtagcacctggtcagcacgaaatcgactttaaatatgctggagcagtccgctcttgtgatgacatccaaacatttaaactagttgtcaaaacaattgcccgcaaacacggcctgcatgcgacatttatgccaaaaccattgttcggtgtgaacggttcaggtatgcactgtaatctatcactcttcaaaaatggtgttaacgcattctttgacgaaaacgcagatcttcagttaagtgaaacagcgaaacacttcattgcaggtatcgtgaagcacgcaacaagctttacagcagtaacaaacccgacagtaaactcttacaaacgtcttgttcctggctatgaagcaccttgctatgtagcatggagcgcgcaaaacagaagcccgcttatccgtatcccggcttcccgcggcatcagcacacgtgttgaagtacgcagcgtagacccagctgcaaacccataccttgcacttagcgtattgcttgctgcaggattagacggaatcaaaaacaaactggaagcgccggctccaatcgaccgtaacatctatgtgatgagcaaagaagagcgcatggaaaacggaatcgttgaccttccagcaacacttgcggaagcgctagaagaattcaaatcaaacgaagtcatggtcaaagcgctgggcgagcacctattcgaacacttcatcgaagcaaaagaaatcgaatgggatatgttccgcacacaagttcatccttgggagcgcgaacagtatatgtctcagtattaatctttcaatcccttggcactattggtgtcaggggattttttgatttataatataaatcatgtgcgaccccacaaaacatccacaaaaaatcaataataattggggagacatctcttacaggtgccagataatttttaaacaaagatcacaatttacagcaaagtacaccgtctgtcacaaatgaatttaaaaaagtgttgccagtaaagaatgaatttcaagacttatcgaaaaactctgtgataattccattgttcaatacttctaccagcaataataagatgagtaagttggatgtttattattgacatcataaccaaataaatccataattgcgttgaaatctaaatcaattttcaaaaaggagatttctatgaaaaaattgactatcttctccgggggattaggagtggttttttctgtactggctcaactgtttgcggttatagatgactcttacactttgaggaatttatggtttttaggtgctttggcgggaattataaccatgcttgcttcaatccagacaaataataaaccaatcttcagcattttattaatttctagttcagtaataggtctacttggaactggtcttgtatacatcataccaacactattcaatataataataatttataaattttcaaaagtaagccaatggtaaaataaaggttctttttttatttagtatttctttgacaaggtcggtaatgaatcgcagaatgcttatgcttgcaactggtccacacagctggggcttccgtgggcatgattatcgaacgccatgtttctaggataccggaattgaaacatttgatgagacatttcgtgaagctgatcaccaaatgaccattttcatagaggcacgtctaaagaagctatcataggaggataatactgtgtggaaagctttaagtcaattactcaagaaacagaaaaatcaaagtccaagcgatgaagattatatacagattccagaaaaggattttaatctagaattaaaacaaatgatatttgagttggagagccagggggaagtagtatcgaaaaagctgcagaataagtatatagatatttttgaagcacagggtaaaccaaaccttagcatcaaaatttgtagagacatagatggagatgtgctaaatgattttacagctgagagatgttttgaaaaagagtaccgttcacaaatagcaattaattactatcaacctgcaatagtctgtgatgaagaattagactgtttcacaatggatttgtggtattactacggtggatataagggtacaggttatggaacattattcgatttaaataataatgacttagaaaaagaaattgaagaaacgctaatatttttactcaatgacaaacaattcgagaaataaaaaagaaagccgcaaagagctttcaatcaacgttcatttgcttagttgtcttgatccttgtccattttatgttggtaaagcagggtggggaactaggcactccattcagatatttctttattaactcagtcaatttttaaacgtttcttcacttatatctaggatttgataaaaataaagaataattgttttttttgttatattaaatatatagcgttggaaatatgaaaggtggattaaaaatgaaatatgataaagttttagattcaacatctccatatgggcctcaaggtcttttggaaaaagaggggcttttaatatctactagattctgggcaaatactcaagcggatattcttactggaacgggtttacctgtgagcgatgaagagatgaaaacttatctggctataccggatgacgttgaaattcctcaagattttcaaaaaatatatgatgtttataacgaatataaacagttgtgtaactggtggatgaagaatttattcagcagtgttcttaatatggttaacgatattaataatattggatccttggcaactagaacgataaatagtgatataaaattattacaaataatgtctaacgatagcaatgaacaaggaagacaagaggctgcgaagcaatttcagtcttcctgttcaaagcttgctgcaatactcaatcaacaacaacagtctatgaaagaggttcaaaaccaattaaattcccttcttcaaggtagtgacgactgtataggtgttagacaattgaataattctttagaaaaagaagtcgcatatttagattcacagtataatgatgagagtgagatacatgattcaataaatatgttcttaggattaaaaaaattattgggtatatttgttgaaggtcaagatattaatgagaaagtaaaattcagctttgatctagggcctttatttggttttattgtatctgaaatattagagtgttctgatatacaatcagttaaacaacaaattgatcattttctgaatatgttaaacaatatagatgcacaactttcattagaagtaaaagttttggggatgcttcacagtatcaatatagacttggttaatgtaatagcccaagcagaaaagtctaaggagtttataggacaaatcgaaggcatctggcattctataacaaatcaattttattcactcgcccaagggtttgagaatgaggatatcaataagctttctacggatcttgatcatgctgccgccacttgggaagctgttgctaataaagcaaaagagtttgtaacaaattcataccaagggtaaaagaaaaataagggcctgaaagggctcttttgcttatagtcatatttcccgaagtattacttttttggatttattgaattttaaagcgtgtttgttgcactgaattcatagtcaaaaggggaatgtttttatgcttggaatcaacgttgaaaaatcaaatgaaaacttaattatcaattggcagctatccaaaattgaaatcccaatcaaagaaatcaatgatgtatttcttgatccaaactatgggggagaggaaaaaagtgcagttaggatcgggtttccttatggctctacggatagggtagtgattaaaacagcaaatcacacttacattttgttcaccactaatgctgctttaattatgaataaaattgtttctttataaacagtttatgccccttttaaatttatttattaatgttctgtgtgggaaaaatttaatgaggtgatttaaggaggagcatttatggaagaaggaaagttagttcacatgactctagatggtattaagaaagcagtttctaaatatggtacattccctatgtttcatcatggaggatatgtcatggaagatgctacttttcatttcaaagatcctgctagtcctcaagaaattagcgatatagaacagaagctaggtgttactttccctaatgactataaagagtttttgttacagcacaatgggatggaaatgtttgatgggattgaaatacttagcttagagggaatcattgaatataatgaggttcaagatttcccagagggatacgttttaattggatatcattttgatggaagatatgtcatagacacaaacaaatcaaaaaatggattaggttatatgctatatctagactcaattgatgatattgaagatgcgattaacttagattctaatttcgagatatggtttgatatgctagtgtcttcaaatggaacgaaatattgggaagtaaatccgaatctccaagagtactataaactggtttcagaataacacttcggcaaaagaaaaaattatgactaatttcaacaaccaaagaatctgcaatttgagggaagtataatgacaatttacgagcaaattaaagatgctttgaaaaataagatcaatgagttggtttcaccctcaagaattaaagaaaacccttcaagaaaaatacggaactaatccggatagcattattttatcagattattgttataaccggtttctagcaagaggcaatattgttgaataaggatagtcatttaaagaggttattgttgtcttcatattgaaataaagattaagtatatttgaggggagttagttactttaatgcacataacaacaaaaaggttattgatacgtgaatttgaatgcaaagattggcaggctgtatatgagtatacatctgatagtaatgtaatgaagtatatacctgaaggggtttttactgaagaagatgcaaaggcatttgtaaataaaaacaaaggtgataacgctgaaaaattccctgtcatactaagagatgaagactttcttataggccatattgttttttataagtattttggtgaacatacatatgaaattgggtgggtgtttaatcccaattatcaaaataaagggtatgcttctgaggcagcccaagctatctgggaatatggatttaaagaaatgaacttacataggattatagctacgtgtcaacctgagaatattccctcataccgagttatggagaagattggaatgagaagagaaggcttttttaaaaaatgtattccaaaaggcaatgaatggtgggatgaatattattacgctattttagaggaagagtggaattgaactttattgagtgcggcaatacaaacaaaatatcaccctctacttagaacatattagttaaatgaaggtgatatataaagtgatatgacagtgattaaatgggattcaatgagctccggtgaattgtttttgggtgagttcactaaggatgatacctgatacgcagccataccattcgagcgttaatcattttataactgatcttttcacttttgcccacgggggaataagaccctatttaagttcgccagacgattgtttgatccgttgttgatgattgtcaggattttttgtgaaggaatatctttatatagtggttgattattcccttctggtaaaaattgatctatgttgaattgcttaacatgtcattatcttttagggggttccaaaaagaccgtattcctatcgatcgctcagagtgaaaatggtatactaaagttacaatcacaggaaggaattacaatttttctaggtctacataaaatcatctgattaatcgaaagtgagaatgtgatgaatgaatttaatagggtatatggaggaaaggtttcaaaacctcgaattaattcctagcatctataatcaatggggcacaggaatccatttttgtcttggggaaaatatctatcaactcaaagcaaatgaagaattgaatttaaagatgtttcgggttgtatatgaacaaacctcaatcatttttaatgaattatttgaacaaaatgatgacatattccttgtgacgaatatgtataagcacaaaaagaaagagaaatgtataagaaaattaaaggtgtatcaaccgtttctaaaatgtaaaaatcatttgaatcaaattatggtgaagacatatccctaccctttcgaaatcaataaagctgaagaatacgagatgcaacaattttccctgttatgcaaacctcgagacttacgtgtaactgaattacttaaagcagccagtaatgaggattttccacaaaaaccgaaattcggaggttactctattgattaccctgatgttttctttgtgaacattacaaaagacattattttctttatctatgatgaccgcggatgcgaagtcatagctcatgatttcaaacgaatacgtccactttatgaaaaatatcacgactgggtagaagagtataagtgcatgtaatactcttttataaaacgatttatatcaggaaaggcagaattagattatgagggccttacatacaagatttaaacggttattgaaactgagaaacttagaattttttcagttggtattatgtgatgatgagagatctgcatttttattagtagttgataaaagattagtggccttttagataaaagaatccttttaaaatgaccttcaatccaattctgagtactgatactcaatttatttttcttgtgagaaaagggtttaaatgagtttgtggtatttactacatgaaacaaattgagggcttaagaaaaatcaagaaacaattgaatcttagtaatcatacaacaaatattagggaggtaaaaatgaaattgtataatgaatttatcaatatagctaaaacgtttaataaagagttaggcataattccattattatatggctctttaggtcttgaaagggtaactgggttagacttttccccagaagatattgatatccttattcctttaatttttttagaggaaaagcgggaaaaactaaataaacttatggaactgcaagggtacaaaatggttgatttacatgagcatgaatttaagaaaactaatacaaaaataggcattgcttacattgaggatttaaaaccatttgcagatgtagactataataacctagaggtttttgaagatggcggagcgaaatatcatttgctaacgattgatgattacctcaagatttataaaaagtctttattagatggttatagaagaaggaagaagaatcataaagaccaaagtaaaattaacatattgaataaattaatacggaattaatttctgtattctcttttggtttccagtctcaattaaaatttttaagattaaaataagtttgaaaggataaatcatagtgtttaacacagccattaatcctcagacagtcaaatagccatttctactccggttgaaagcttctcaatttttgcttcttatttatctttcctgtattgatatatgtatgtagggttggacttataacataaactattctggccattcctgttctttcaatcatgaccgggcttgccatcagcataaatctaggctaacagtcgccatacatcctgtgatcacctttatcaaactcttaaatgcaacttaccactaaccaattctttatttcgcatagatcatctttgtcatgtgtttacacaagaatctgttttggactgagacactgaatataacaaaacagtcaaaaatcaatatttaattcattctgtttaaactttctgaaaaagatgttgaaaaagtcgaaaggattttataatattaagtcaagttagtttgttcgatcaacaaactaatgaaatgaactttcattatccacaagataagatcttattaatatggatggaagggggataagagggtcgatttaatggagctaaacaatataagaaacgaaagaatgaggcttttatccttttccaggtatataaggtatgacgaaaaaagatgaattttttgcttgctgatcaccatatttttttgcactgttttgaaagcgcttttataaaagtttactgaccgtaaattcgagaaattgttataccgtttcacactgttccatattaaaggatcgaaaaggggagaaatcatgctcagtgaaaatgtaaagaagattagcatggttgaaaaagttggatatgcgtctggagattttgcttgtaatttaatttatgcaacagtgtctacgtatcttttgttcttctatacagatgtttttggtttatcggcagcagcagccggtactatgtttttagtggttagaataatcgacgctctcgctgatccttttatcggaacaatagttgacagaacgaacagcagatttggacgctttagaccgtatcttttattcggagcttttccatttgtcatactggcaatactctgttttacaacaccagacttttcggatatggggaaattaatatatgcctatataacctatgttggcttgtcgcttacatacacaacgataaacgttccatatggcgcgttaacttctgcaatgactagaaataatcaagaagtggttagtataacttctgttcgcatgttatttgcgaatcttgggggacttgtcgttgcattttttgttcccttactggctgcttatttaagcgatacttccggcaacgagtctcttggctggcaactaaccatgggtattttgggaatgataggcgggtgccttttaatcttttgttttaaaagcacaaaagagcgggtcactcttcaaaaatccgaagagaaaattaaatttacggatatatttgagcagtttcgtgttaatcgtccacttgttgtattaagtattttctttattattatttttggagtgaattccatcagtaattcggttggcatttactacgtaacgtataacttagaaagagaggatttggtgaagtggtacggtttgataggaagtttgcccgctttggtcattttaccgtttattccaaggcttcatcaatttttggggaaaaagaaattactaaactatgcattattactgaatattatcggcctcttagctttactgtttgttccgccaagtaatgtttacctcatacttttctgtcgattaatcgctgctgctggaagtctcactgccgggggatatatgtgggcgcttattcctgaaacaatagaatatggagagtacaggactgggaaaagaatgggtgggctcatttacgctataatcggatttttctttaagtttggtatggccttaggaggagttgttccgggtctggttcttgataagtttggatatgtagcaaatcaggcacaaaccccaacggcattaatggggattttaattacaacaaccattattcccgtgttcttgcttgttctagctttaattgatattaatttctataacttagatgagaaaaaatataaaaacatggttcgagaattagaaaatagagacaaagtttatttggatcatattgacgatttcaaggcttaaaaaagaaaataaactgaggaggaattccatatgaaaattatcaatcccgtacttaaaggattcaatcccgatccaagtatttgtagggcaggagaggattattatatcgcggtatctacatttgagtggttcccgggagtccagatacaccactcaaaagatttagtaaattggcacttagttgcacatccattacagagagtttcacaattagacatgaaaggaaatccaaattcaggtggggtttgggcaccatgtttaagctatagtgatgggaagttttggctgatctatacggatgttaaggtagtagatggcgcatggaaagattgtcacaattatttagttacttgtgaaacgattaatggtgattggagtgagccgattaaattaaatagctcggggtttgatgcttctttgttccatgatacggatggaaaaaagtatttattaaatatgttatgggatcaccgtattgatcggcactcatttggaggaattgttatacaggaatattctgataaagagcaaaaattaatcggtaaaccaaaagtcatatttgaaggaacggatagaaaactgacagaagctccgcacctttatcatatcgggaactattattatttattaactgcagaaggaggaacacggtacgaacatgctgctacaattgcccgttctgcaaatatagaggggccatatgaagttcatcccgataatccaattttaacgtcatggcatgacccaggaaattcattgcaaaaatgtggtcatgcatccattgttcaaacacatacagatgagtggtatttagctcatttaacgggacgtcctattcatcctgacgatgattcaatttttcagcagagaggatactgtcctttgggcagagaaacagctattcaaaaactttactggaaagatgaatggccctatgtagtaggtggaaaagaaggaagcttggaggtagatgcaccttctatacccgaaacaatatttgaagcaacgtacccggaagttgatgaatttgaggattcaacattaaatataaattttcaaactttaaggattccattcacgaatgaattaggttcattgactcaagcgccaaatcatttacgattattcggtcatgaatcattgacctcgacatttactcaggcatttgtagccagacgctggcaaagtctccattttgaagccgaaactgctgttgagttttatccggaaaattttcaacaagccgctggattagtgaattactacaatacagagaactggacggctcttcaagtcacgcatgatgaagaacttggccgcattcttgaattaacaatatgtgacaacttttctttttcacagccattacacaataaaattgttattcctcgtgaagtaaagtatgtatatttaagagtaaatattgaaaaggacaaatattattatttctattcttttaacaaagaagattggcacaaaattgacattgcactggaatcgaaaaaattatcagatgattacatccgtgggggaggattcttcacaggggcctttgtagggatgcaatgccaagataccagtggtaatcatattccggccgactttagatattttcgttataaagaaaaataatttgcacatgaaaaaggagatttctattttagaactcctttttcatatgagaaggtgcctatgtcactattgcttcagaaatactcctagaataaaaaaactcatctttaaagatgagctgtccattccattaaaattacattgtaaccatgtccagaaaatgatcaatcacaatggaggacattcctaatgccggcgcattctgtcctaaggaagatggcaataattcatagctattgcctaattgggaataaacccttgacgacacttcacttctcattgaatttaaaaccataggatgcgattcaattatgctatttcttaaaattacggcctgtgggttgaaagtatttaaaatattggtaaggcctattcctaaatagaatccaaaattctgtaatgcgtttaaggttccgatatcattcagatgggcgaggtctatgatatcttgataggacagttttttctctttggtctgaagagattttaataaagccttctctgaagcatacaattcccagcagcctcggtttccgcaactgcatttaggaccattaaagtctattgtcatatgtcccatttctccagagaagccgcttactcctctatataaatgattgttgataataacaccgatccctattcctgtgctgatacttacgtaaataatgttatcgtgattttttgcagctccaaatactttttctccatatgcgccagcatttgcctcattttcaataaaaacaggcacattgtacttctcttgtattgaagattttaagtcaatatctctccagttggagttcggagtgaaaacaattttttgatctttatcaatgagtccaggcacgcaaatacctataccaataagcccgtacggagattggggcatttgcgtaataaagtgatgaatcatatcaatcaaaatgtctttcgttatttctggagaattggattccaaatggcggtattgatcaagaacgattgttccttcaaggtctgttaaaatgccattgatataatccacaccaacatctattcctacggagtatcctgcctttttattaaaaacaagcatgacaggtcttcttccgccacttgattgtccttgacctatttcaaataccagattttctttcattaacgtgtttacctgtgatgaaacagttgatttatttaatccagtcatttcagataattttgctcttgaaataggtgaatttttaaggatttcttttaataataacttttgatttacttttttgacaaaggtttgatcagcgatatccacttcatccactccatttgtttaatctttaaattaagtatgaacatagtacatagcgaatcttccctttattatatctaatgtgttcataaaaaactaaaaaaaatattgaaaatactgatgaggttatataagatgaaaataagttagtttgtttaaacaacaaactaacaggtcacttactatatgaaataaaatgcatctgtatttgaatgaatttatttttaagggggaaatcacatggctcaatctcattccagttcaatcaactattttggaagcgcaaacaaagtggtttacgaagggaaagattcgactaatcctttagcatttaaatattataatcctcaagaagtaatcggcggaaaaacgatgaaagagcatttgcgattttctattgcctattggcatacatttaccgctgatggaacagacgtttttggagcagctacgatgcaaagaccatgggatcactataaaggcatggatctagcgaagatgagagtagaagcagcatttgagatgtttgaaaaactagatgcaccattctttgcttttcatgaccgggatattgcaccagaaggcagtacgctaaaagagacaaaccaaaatttagatatgatcgtgggcatgattaaagattacatgagaaatagcggcgttaagctattatggaataccgcaaacatgtttacgaatccccgtttcgtccatggtgccgcgacttcttgcaatgcagatgtgtttgcgtatgctgcagcacaagtgaaaaaagggttagaaacagcaaaagagcttggcgctgagaactatgtattttggggcggccgtgaaggatatgaaacattgttaaataccgatttaaaatttgagcttgataatttggctagatttatgcatatggcagtggattatgcgaaggaaatcgggtacacagggcagtttttgattgagccaaaaccaaaagagccgaccacccatcaatacgatacagatgcagcaacaaccattgcctttttgaagcaatatggcttagacaatcattttaaattaaatcttgaagccaatcatgccacattagccgggcatacattcgaacatgaattacgcatggcaagagtacatggtctgcttggctctgttgacgcaaaccagggtcatcctcttttaggctgggacacggatgaatttccgacggatttatattctacgacattagcaatgtacgaaatcctgcaaaatggcggccttggaagcggcggattaaactttgacgcgaaggtcagaagatcttctttcgagcctgatgatctaatatatgcccatattgcagggatggatgcatttgcaagaggattgaaagttgcccacaaattaatcgaagatcgtgtgtttgaagatgtgattcaacatcgttaccgcagctttactgaagggattggtcttgaaattatagaaggaagagctaatttccacacacttgagcaatatgcgctaaatcataaatcaattaaaaacgaatctggaagacaggagaaattaaaagcgatattgaaccaatacattttagaagtataacaggataagctccagatcctgctatcaataccaagtcactgaattacccgtcatgattcctttcctattgcttgttgttatgacgggtaacttctataattaggatttatttagagtgaatggttttttaaaagggcaaggagtgaaaaaatgaagtatgtcattggaatagatcttggaacgagtgctgttaaaaccattttagttaaccaaaacggcaaggtttgtgcagaaacgtccaaaaggtatccgctcatccaagagaaggcgggatatagtgagcaaaatcctgaagactgggtgcagcaaacaattgaagcattggctgaattggtttctatatccaatgttcaagccaaggatattgacgggataagctattcgggacaaatgcatggattagtactgcttgaccaagatcgtcaggtgttacgtaatgcaattctttggaatgataccagaacaacgcctcaatgtataaggatgaccgagaaatttggcgatcatcttcttgacatcacaaaaaaccgtgttttagaagggtttacattacctaaaatgttatgggttaaggaacatgaacctgaactttttaaaaaagctgctgtgtttttgcttccgaaagactatgtgcgattccgtatgaccggtgccattcacaccgaatactccgatgcagcaggaactttacttttacatattactcgcaaggagtggagcaatgatatttgcaatcaaattggtatttctgcagatatttgtcctccgcttgttgaatctcattattgtgtagggtcgctgcttccgcacgttgccgccaagaccgggctattagaaaaaacaaaagtgtacgctgggggagcagataatgcttgcggcgctattggagcaggtatcctttcttccggaaaaacattatgcagtattgggacgtcaggggtcatactttcctacgaagaagaaaaagaaagagactttaaagggaaagtccacttttttaatcatggaaaaaaggattctttttatacgatgggcgtcacgctcgctgcaggatacagcttggactggtttaaaagaacgtttgcaccaaacgaatcgtttgagcaattattgcagggggtggaagctattccgataggagccaatggactgctatacactccttatttggttggtgaaagaacgccgcatgctgattcttctattcggggaagcttgatcggaatggatggagcccataatagaaagcattttttgagggcaataatggaaggtatcacattctctttagatgaatcaattgagctattccgcaaagcgggaaaatcagttcatactgttgtttctattggtgggggagctaaaaatgatacgtggctgcaaatgcaagctgatattttcaatgcgagggtaattaagttagaaaatgaacaagggccagctatgggggctgcaatgctggctgcttttggaagcggttggtttgaatcacttgaagaatgtgcagagcagttcattcgtgaggctgctgcattttatccaaaggcacaaaatgtacaaaaatataaaacactatttgatttgtataagaacatttacactcacacaaaggatctcaatacagctttgaagagctttcgaaaaaactaatgatgttattgtctggagatcaaccgaagaacaattaatgatcaatcatcattaaaggcctttgatgacatggctgccttcttttgaaaagatggtgagaataaggtatggcaacctttaaacagtattggagtgtccagcagacaaaacgaacgagcggaaccgtattctgtcagcgaacacttcaagaagtgggaaagcttaggaatgccaatgggtaagatgtatgaaaccgcgctaacgacggtagagggatctcttgatttatgatgaaataggaaggatgtttacacacaaataaccccctcacattgacgtgaaggggtgttttttattgttactatacagcggaaattttacaggctagttgatgattttagcttgataagcagaatggaaactagacacgccatcatctctttctcattctttggaaactgcattctgctaggtttgctgctttttttaacgaacagtgtttttctatttcacacagccattaaatcctctgtttgtcacataaccgctcttactccaaattgacagtttatctgattttgcttcttgctcatctagtctgaattggtctatgtattttgtgttaggctcatatacatatgctactctggccaatccctctttcaataatgtctcttgaacagatttgccgtcaacataaacgtatgctaacagtcttccatacttatctctgcgatcgcctttatcaaattccagctgtagcttaccgctgttgaccaattctttatttcgtttcgacgcatcctcaccgtatggttgaacacaagaatttggtttcttcgtctcaggtgtatcaacgagcaagtagcgaactgtgtctttctttccgttgtaaataaccttaatcgtatctccatctattgctctatctaatgtaacattgaccaatttcttctgcttttttgaatgaggcgtgccggccttttgttctgtctgattatattcattagattgagtatcttgagagacttgctccgtcccattagaatctgaatggtttttggctgcgtgatgtgatccgcaagctgccaaagtaatacttaaaacgattgcgatcatactgatcaaaatcttcttcatattgattccctctttatcattttctcttttcgcgattaaacatcatcattataacgatatggacattttttgtgaatggaaaacttcaagggaacttataacactcaaattgccaatagttaacttcataataagatgatcaaaacataaccatcacatagcggaaataaataattctgaaaataatattgattgaaaatgcttttggaattatgataatatgagaaatgacaataatgtgacaaaaacattactacaacataacaactaatagcttatgtttattctattggctaaaatgtaaacggttacaaatccagaggcgaaaatctaagatagagatgacgttagttttgactcaatatccacactgaaagagcttattaagtattcttaataaaggcaggggaaatggatatgaatgaacatcgaaatcgaaggttgaaattaataatgatttcagcaacttttggagggcttctctttggatatgacaccggagttataaatggagctttaccttttatggcaaggccagatcagcttgatttaacaccggttacagaagggcttgttacgagtattcttttattaggtgccgcgtttggagcgttgttatgcggaagattggctgatcgatatggccgccgtaaaatgatccttaatctttcctttttatttttcctggcatcactgggaacagcgttagcacctaacgttttcatcatggcggtctttcgttttttactggggctggctgttggaggagcctcggcgatggtgccggcctttttagcagaaatggcaccgcatgaaaagagagggcgtatggtaacccaaaatgaactaatgattgttggcgggcaatttttagcatatgtttttaatgcgatcctcggtgtaacaatggcaaatacgggacatgtttggagatacatgcttgtcatttgtgctgtaccggctatcatgttatttgccagtatgcttaaggtaccagaaagcccccgatggctaatctccaaaggcaaaaacagtgaggcgctgcgagttcttaaacaaattcgagaagataaacgtgcagaagctgaatgtagagaaattcaagaagcggtagaaaaagatacagcactagaaaaggcatcactcaaggacttttctacaccatggctgcgccgtcttttatggattggaatcggtgttgccatagtgaatcaaattacaggtgtgaactcgattatgtattatggcacacaaatccttaaagaatctggttttggtacaaaagcggctttaatcgctaatattggaaatgggctgatatcagttattgcagttatatttgggatttggctggtcggaaaagtgagacggcgtccaatattattgattggtttggcggggacgactacagcgctcctattgattgcgattttctcaattgtgcttgatggatctatggcacttccttatgtagtgctttctttgaccgttttatttcttgcctttatgcaagggtgtgtaggacctgtgacttggcttgtcatagcggaaatattccctcaaaggttaagaggacttggttctgggataagtgtttttttcctttggatattaaactttgtgatcggttttgctttcccgatcttgcttagctctgtaggtttgtcttttacattctttatatttgtggctttaggtgtattggcaatcggttttgtatacaaattcatgccggaaacaaaggggcgtacacttgaagaattagaagcgcattttcgttctcgacacgatcataatactcctgaacaatcaattattgaggtataaatatgttgaaaatctctcttcttataggagggatttttttagtttcagaaaaaacaaaatccctctggtagagggattttgattcagcattttaagatgttctacacgtataatactggagttgatactttaaaaatctcgccatctcttatataaaaacgagggatgcggcggcttaatgtagacacgacttcatagttaatcgtattgagcatttcagccacttcatcaacggaaatctcggctcctttttgcttaccgtaaatcacgacttcttctccttgtttaccttcaccgttttctcctaaactgaccatgatcatatccattgttactcttcccgccactggcactcgttttccgcgatgaagaacaaacccgcgattggaaagggcacgagaatagccgtcagcatagccaatcgggagtgtaacaattacttcattaggttctgcgacgtatgtagcaccatagctaacggttcggggttctgtacgcatggttttcacataagcgatgcgcgcctttaaacttaacgcaggttcaagcttaacgagatttagttgtttaatataggctgaaggatataaaccatataagccgatacctaaacggatcatatcagcgctaaattccggaaatgcgatagctgcagccgtgttgcacatatgcacggtgggcagctcaatcccctgtttttttaaaaagctgagaaaactgatgaatttttcgtgctgcagctttgtgagtgttgtgtccggttcatcagctgtcgaaaaatgtgtgaaaatccctgtccatctgaggaatttacttgcctttaaggctttcactacttctaaaagttcttcctttgtgcgtacacctaatcgtcccatgccggtatccacgttaatatgaatggccagccggttagcactcgcttctttttccaatatctcgtttgcttctttcatccaatcaacctgaaatgctgataatgttatattccaagctgctgacttctttacacaactaagggatgtaaaaccaagcacaaggataggcgctgtaatcccagcttttcgtaaaacgattccttcctccacactggcaacagcgagctcactcgccccgtgttccagtacatggcgtgccacttctatagacccgtgaccataaccgttcgcttttacgacagccataattttgctcttatgtggaatatgacggcgaatcgctcgcaaattctttttaacggcatcaagattgacttcgatccaaacttctcggcaaagctttatcatcaacgcttccttccttcttatggattataaataccacctattgccgcaagaataaatgttaattgttggatgattcgatcttattttattcaactttatttgaaatcattcaacagcaaatccatgtgatacgagaaggtgcctatcaatgttcgaataatagcaagtacgggatacatgaggcttgtaagtggggtgttaatggatacggcgaccgaggattacaaaaatgattatttgttttgggacatttttttctaagggtagatgataacgagaaatctaatcaggaaatacttaccgttcatcaatacaaaggatacaggttagaattagtgatgtttgatgtttgatgtttgatgtttgatgtttgatgtttgcagtatagaagcacagaaaaagcaaggaagtaacagcaatcttccttgctccattggattcctattagagagcacgcacttttgcaaaagcttttatcttagctccatcatcattttgacagcgaatataatatgttccggttttatagtgtgatacgtcaagagttagagttacacttttgccaggtttaactgtatagccggaagcgattgttccaccacctggttttacaattttgaattcaaatggattgcttcctgtattctcaacaaaaactctgatttcgccatcttcacttccataataatcaaaataaaattttccgtcacctctaaacgtttcttcctcttctagtataatatcggattgtgcggcaaacgcagtgacttttttaggtgtgtggtcaattgatgcagctgaagcataagtagagcttaatcctgtaattgaactaactaaaatcgaacctaccacaattttcttaaacacttttcttcatctcctatataagaaataaattacaaaattatacattcggtaaagagttggaaagacctttgggaaatcctataattcacaagaaatacaaaaagggtatgtttatttctggtgaatatttatgacggagtaaacatgtcataacatcaggatgattaaagcgtaatcaagtacggtctgagacaagcaggacactacatatgaaggcactgactggctaacttttctcaacaaagacaagagaacaagagggcgtctattgttatgaacattgaagaaccttttaaatgaggagggctgaggaaattctgtaaaagataatcggttgaaaaggcagtcgattccttgttccataaacctaacattagagtatataattaaactcgtattcacaaaaatcgtttaagtaaggggtatacatgaataggggagttagttttcaaataccgaatgaatatggaaattttctatggagaatactgcagccggtagaaatagctaattataggtggcaaacgagtggggaatcttattttgttgtagaaggagagctcgatgatgaggagctttttcatgactacgcaattgttgaaggggcagtttttgagcaacaattaaaaacgaatcagtactataccattttcgttgaactgaaagcatttccatatggaaaaatggttaatcaagtcaatacatatgaagagtttgctgacagtgattgcgaacttgtccttttgatagcagataatagctacgtttcgatttactgtaaaaacaaaaatatcattgaaaaactttacttcaatgctttacagaatgattttgaagacgttcaatttataactgatgaaaatgacacaagaacaagccttactgtatgatagtcaataaaaattaaaggagctagtacatgacaatgcaaattaaaatcaagtatctagatgaaacacaaacaagaatcagcaaaattgagcagggagactggattgatcttcgggcagctgaagatgtaacaatcaaaaaagatgaatttaagcttgtcccattaggtgttgcaatggagctgcctgaaggttacgaagcacatgtcgtccctcgttcaagtacatataagaactttggcgttattcaaacaaattcaatgggtgttatcgatgagtcatataagggagacaacgatttctggttctttcccgcttatgcattgcgtgatactgaaattaagaagggtgatcgtatctgccagtttagaatcatgaagaaaatgccggcggttgaattggttgaagtcgagcatttgggaaacgaggatagaggaggactcggttcaacaggtactaagtaaacaaaataaatccttggctgtcttcatgctgtgtgattgatcaatggaggtttcagccaaggtacaaagaaatacttttatctaaatttttataagtaggggaaggcaactacaaactagtaatgccactaataataagccaagttaaatgacatgtgttcattaataattgaatttacagcagccatgagaacaagttcaaaatataagatgaaatgagacataagacttcacaaaaaaatctgagtaccgtcgataaatatcataaaaaagcccccggtatgtcgccggggaataaatagacgtttaagagatttagtgatgttttttatatgattcgacaaaatcataataatgatcatcgtcatcataatactttttttcgtaatgataatcgtgatcatcgtaatactttttatcatggtcatcatactttttatcataatcataatgttttttatcatgatcataatacttgtcgcaatcataatgcttcttatcattgtcgtaatactttttgtaatatgtttttttccaagtgtaatactcttctttatattttttataataacccaattaaattcctcctttatgttattcgaatttaatttatgaagtttaaatgatatggtatggtcaaataaaataagaatagtaaaaagaggctgtttaaaacactttctgaaaaacaaaacggatagctgtttaagagcgagagagagcactcaatcactgtaaaataatagtaaagtgtatagagaagattagtatacgtaaaaagggactttctcattgaagaatatttgaacgttatggttaagattcaagagctctatgatgtgatttttaacactgcttttgaagggtttagagttagacatcaaaacaaacatcaaaaccggttagaaacagatcatataaggaatgaaccgctgccaaatatcataaaaaagttgttaatgatcaaatgaatgaaattagagagaatttattttaaagaaagcccaattgcacatggacaaatgacaattgatattgaggtaaaatacaatgcattaaatcagaaaaagctattggaggatttaatgtgtttagacaatttccaatttggtatacacaaacacctgactatttgaatttttatgtgccgcaatatcaaaccatttcttataatcctcaacaatgttatcaacggtgtatgtaccaaactggcggtaactatgagctatgtgacagactatgttatggagaaatacaggtgtaaaagagggggttattaactcctctttaaacacacagtgagtggaataagatcctcactttatctgcgagtgcttagtatttgcgataatattgtattcgtaataaattatgcttagcaactgaaaatgaaagaaggatatgaatagtcatgacgcaattcgataaacaatacaattcaattataaaggatattatcaataatggaatctcagacgaagagtttgatgtgagaaccaagtgggactcagatggaacaccggcacatactctaagtgtaatcagtaagcaaatgagattcgacaactcagaggttccgattttaacgacaaaaaaggttgcctggaaaacagccattaaagagttgctctggatttggcagctgaaatctaatgatgttaatgatttaaacaagatgggcgtacatatttgggatcagtggaaacaagaagacggcaccatcggacatgcatatggatttcagctggggaagaaaaacagaagtctaaatggagaaaaagtggatcaggtagactatcttcttcatcaattgaagaacaacccgtcttcacgcagacatattacaatgctgtggaatcctgatgatttagacgcaatgtccttaacgccatgtgtatacgaaactcaatggtatgtgaagcaaggtaagctccacctcgaggtaagagcacggagcaatgacatggcattgggaaatccattcaatgtattccagtacaatgtgttgcagcgcatgattgctcaagtgactggttatgagcttggtaaatatatctttaacattggggattgccatgtgtacacacgtcatatagacaatttgaaaattcaaatggaaagagaacagtttgaagcacctgaactatggatcaatcctgaagtgaaagatttttataactttaccattgatgatttcaagttaatcaactataaacatggggacaagcttttatttgaggtagcggtttaatgctgcctttttattgtgcagtgaatggatagcaggtatcctaatttcattaagcaatctggaagatgaataaaaattgaaggacaaacacgtataatacataaaaaagattaactctacagttaatcttttttattcagaagaaaatatcctaactttgaaactaaatacaaagtaaaagcaatcattacagttctagatattacaattccatgaatagctaaatcatatccagcaggtaccaacgcatttgtattacacataaaatatatagatattagaagtgctacaataactaaaatcattccaaaaagacttgatttttcatatttcataccaatttccacccttattaaagttaggtttaaacaaaagagctgaagaaacgaactatgaccagtatgctccaaagaaaaccgccagacaatgctggcggctttttgctgcttcgtttatttatgaacagagatcgtaacgttatttcctgcaactgaaacctttgcgaaatcctgtgtatctaccacaggagtgacggctttattgtcgattgtgatgttgttaaaagatgtcgaaaaggttgctttgatcgcatcacgctggctttcatacgaaacagccgcggtagcaagggttttccattttgaaatcgtgccgatgttggttccttgaatttctgtgataatccgtccggtgtagccgtcattgttcgttccccaaagggtcatgcgcgtattgccgtttaagtttttatagattgtcatttggactgtgcttccagggcggaagcctttattgtatgtgaatttgtcttttccttcgatgtacgtttcttcatttttggacccaaccttcatgaggggcttccagacattgtattgtttgctgtactgaagcccgatatctgcttcagttccgcttgttgccctaaagccagaataaatatagggagtggagaccgagtcgttgttttttacagtttcaggaagcgtaattttagctgtaaaaacggcgcccgtactgttcaggtagacacggccgccgattccgttaggcagctgggatgctgcttttgcgacttgagcgtctgccgcgagtaagcctggtatacctgatgaaagggttccgaaaagaactgctgttcctactgcacctgcaatcaatacttttttcatcaaaatttcccctttagatagtggtttcgccatttattataccttattttggaactggattgatgtatataaatcgaaaaatatttcattttgagtaaagtaagggacgaaacgcttcgccaatctgaaagctatatacctttatcagaggaaagaatgagatcacaatcgttttaaccgatttgaaattttcctcaaaataaaagtacaaatgcttaaagaaacgattattaaaaggatgcccgctatcgtttcccagcctgtaaaaaagaggtgacgtttcatcaatgtctgtccttgtaaaatgataaaagcacagataccgactaagaaaagaaaacaaatacttaggattgctaacgctttacgtgagtatgttttcatttcatctttaaaatacagcaatacgaaaacaaagcagataacattggctattgtgcttatcacctcaaagcttttcatgacaactgatataaatagacaaagtaaaatgagataaaatacgatgtttctatacaaaaaacctctccttttatgtatgatcctcaaagagtttataaaagtttctttgtaactgcaataaactgaatgcgctcacttatgaactaactaaactatgtactaaatattcactattctttttcagattcagtcaccaaggttttcatagaaaggggagcttcagaaatatacatatagtgcacaaacaaaaaaagacccggcaatagccgggggaaagtaaaaacgaggagatgttaatggcgtttagtagtgttttttatgctttttatactctacaacataatcatagtcttttttatcgtgatcataatattttttatcatagtcatcatattttttgtcgtaatcacagtcatcatattttttgtcgtaatcacagtcatcatattttttatcatggtggtcatagtattttttatcatattcgtaatacttcttataatacgtttttttgaccgtataatactcttctttgtattttttgtaataacccatatatactcctcctttatttttactacgctttattatacggcgagtagattttgcggcttggacagttaaaatcatagaaggaaaaaagggctgtccaaatgattaaaaaaagacagatgacacaaaaacaaatcaaaataaagagccgatttttcatcggcccaaacgatttatcctacatttgtttgtcttctttgttttctgagtcattttttctgatatcctgagtcagtccgcttgttgcttgtttaaattctgataaggcttttcctgctgcacggccaagcgccggcagtttatcaggcccaaatactaaaaaacccacaaacaaaataacgagtatttttgtgaagcttaattccatatccttttccccctgattgaagtacaaccttttaaacaaattataagagatagcagtacaaatgggaatgcatttattttgaacattttaaaaccagcacaaaggcagattcataaaacggctgctgctgaatataatgtccaatgccacctgcctaagaagcagggaggcaggctggatcaattatgtagctctgccgaaaatgatacaaacgtatctgcggctatcattgaaatagaggagtggtgtagctgatgagattcactaaggtagttggatttttgtctgttttagggttggctgcggtttttccattaacggcacaagcagaaaaagccggaactgcgggggctggagagtgggataagttggggacttacacatatacttactcaagtccgacggtatactcgaccggaggagattttagagtgtgcctttcaggaagcactcctttttctgtttcactgcacttatatgaggatgatcccggtgacaatcctgatgattatgtaggggcaaactatttttcacccggagaatgccacacctttggcagtattggaaaatttgtagatgggagcaataacaaggccgagttctttgttaccgattactctggtaaatctaaaactgttacgttttatgattgatggactcaaattgtgaagtataacccttgggaaagaacaaaaaagagagatacctctctttttttatgcttcgacagccttgcgaagcctttcatttacaatgccagtccagccgccatccatcttgccgcgaacgacggagcttttctcgtttgctttgccgatcacttcattcggctctttccagccgctgtgaataagggtaaaccctgtcttttcccccaagtcttctaattgaaaggtaacgacccatccttctgtatcccattcaaaagaaagttcagttggagcttgaacagccaaaactttacaaggggacggcccaaacggtgattgtaagtgaaattcttgtccttctttgagctgaaagtcattgggcataaaccacttggcaatgccttctgaagtagagactgtctcccagactttctgaatgggagcctctagggtaatgctttttgtaatatctggtaatgtgttttcgttgttttgagccatttcgtttacctcttgacatatgatgttttttcaattcaatcatataataactaataagatcatgtccatagcgtgcattatttatgctagagctgctgttcaacagcgtgtcagtcgccagtctgatctgtgaatgggagaattctgcatgttcgagaaagagagagacgtgtatgttgtcatttcgttcatgcttgtttgctcagccgcaactgttatgtttgaactggaattcctgttcagccaatttattttgcgatttttgttttaatagtaaatgagccattttctaaaacaggaggttttttatgcttggaaaaatcaaagcagccattgataacagtccagggaagccggccagaattttagttagtgaaaaagcgtttcagcaattagaggaagaaatgcgctttgtttacgtttccaaaccgaaaacgataatggggattcctgtggaagtttcagatcaggcagaaagcttcaagctggaattttagttttcccagactgctaaaaggctcattttgtgttaattatgcaaaatggtcaggttgatttctttaaaagcatgatgaaatgttcatcatgctttttttattgagaaaaaagacgaacataaaaaataggtatacgggaaaaataatcctattagagagaggggaaatgacagatggataacatgatatcaacacttactgattggaatgtgtggtttcaagcgttagtagtatttctcgttccatatgtaatctataaagtgtttacttggattcatgtataagaaggtgcaatgatgaggtggcggaacaatcagtacaaaacacagaagcagcataaatcagattattcgacagctgaaaagcaggatcaggatgtgttaaccggtaacatcggatacgacttagaacatgtaaaaagaaaaataggacataacggggacgttcatttccgtgagcttgaaatcactcaattacatgtgaaagcggcattgatctttgttgaaggactgtctgatcaggacttgattaataaaggactatcagtgttagtcatgaatcaacctaatcaggtaagcgatgaaatttctcaatccggcaaaggtattttaacttcgaaacagataaaaaatcaaatcgtatcaatcggtgatgtcatagaatcagagaaaatcagtgatatcgtgttgaatgttttcatgggttcgacagcgcttctcattgatggaataccgcaggcctttcttctgggaactgtaaaaaaacaaaatcgaagtatcgaggagccgctttcagaagcgcttgtcagagggccgcgcacaggctttacagaagagttgagtacgaatacagctcttttgagacagcaaggaaaaaatgatcaattaacattgcagagatttgaagtaggaacacgattaaaaaaggatttaatcatcgcttatatgaatgacattgcagatccaaaagtagtcgaggaagtaagaaaaagagtgagagggattgagatcgatcatttgccggagtcaggctacgttgaacagttaattgaggataattatttgagcccgttcccgcaagtacagagtacagaacgtcctgatcgcgtcataagcggattaatggaaggaagagtagccattctgcttgacggcactccgtttgctttgattgttccagtcactttcagcatgatgcttcaatcgcctgaagattattatgaacgatggttcccgagctcgctcatcagattgctgaggttcatcgcagcaatgataacgttattcgcacccgctttatatatatcatttatttcttttcatccggggttaattccgaccaagctggcgatttcaatttccgggacgcgccaaggtgttccgttcccatcccttattgaagccttatttatggaagtcgcaatcgaaattttaagagaggcggggcttcgtctgccaaaaccgattggacccgcaattggcatagttggcggattaatcatcggggaagcagctgtgcaggcggggattgtcagtccaatcatggtcattgttgttgcgctcacagcaatttcttcatttgccatcccgcattatagcacaggtatagcacttcggatgcttcggtttggcgcgatgttttgtgcggcggtgtttggattgtttggagtcattatgtattatctgctgctaagcagccatgtcgtaaaactaaagagctttggtgtgccatacgcaagtccggcagtgccctatcaattaaaagattggaaagactttgttatcagaatgcctcttttagtcatgaagcgccggcctaaaatgatgaatacagataatacaaaacgggtgaagtgatgaacttaacaggatggtgataaagtctcatgttcagcccaaccagtaaaatcacaaccgctcaggcaacgattatcatcattaattatatgcttgctgccggagttcttacgctccctcggacagtaacagaacaaacacaatctcctgatggatggatttcagttttattaggcggggtcctagcggtaatagccgggatgattatagttaaattaagccagcagtatcctcaggagaccttttatgaatactcccgacatattgtaggaaaatggctcgggcatttaatcagtattgtttttattacttattttcttgcactcggtgcatttgaagtcagagtcatgtccgaaatcgtggatttttttctcctcgaagggacaccgtcttgggcaatcattatgacagttctttggattgggctttattcaattacacaaggcctagatccgattgcacggctttttgaaatgatttttccgattacggtcatcatctttttaacgatagccctcatgagtttaggcatatttgagatcaacaatttgcgtcctgtattaggtgatggaatcatgccagttctcagaggagtaaagacaacgaacctttcatttacatgttcagaaattatgctcattttagtagcatttatgaaaaagccgaaaaatgcggtgaaagcggttgtgatcgggacaggcgttgtgaccagtttttatatgattacgctaattatggtaatcggtgcactatcagttgagggagttgtgacgagaacatggccggggcttgacctgatgagaagttttgaagtacctggtttaatatttgaacggtttgaatcattcctgcttgtgatttggattatgcagctttttgctacgtttattatcactttttatgcagcttccctgggagtctcacaagtttttaaaaagaaacccctttcatgtatgtttgtgctgcttcctgttatttatatcctctcttgcatgccgaaaaatgaaaatgacgtctttatattgggcgatacggtcagtcatatcgctttgtatatatttggcgctttgccgattttgctgttagtcatttcgaaatggaggaaaagaggtgaaaagtaaactaaaacgtcaattgcctgctatggtcatggtatgtctgctgatgatttgcgtaacaggatgctggagcagtcgggaaatagaagatctgggtctcacattcgctatcgcaattgataaaggaaaagaaacgaacactgaaaaagagttaaaagaagagggcgggagctatccgaaaaaagacaacattacgctgacctatcaatttgttaatgaaaaagcggcaggcgcgggcacaagcgggggaggcggtagcggacaaggagcgcaaaaagcgtatattaatataagtgaaacaggggattcattacagcagatcggaagtgaggttgcattaagacgggaccgagaagtgtttagcccgcatttaaaagttgttgtcatgagtgaagatgtgctgcacacatttcctatcgacgaaatgctggatcaattttttcgtgataatgaaatcaggctgagctgtcttgttttatctgctaaaggggaagcaagagacgctctccagctgaaagagaacggagaaattccggcatttcggctgattggattaggtgaaaatgaacataaagtttccagaattcttccccctatgacactcgcgaaactaattggaaaactgcattctggcagcagctttttactgcaaaatgtggttgcggcgaatggagcggtcaagtattccggagcagctgtaatcaacggaaaatcgaaaaaaatgataggcactttaaatgaatatgaaactgagggaattacatggattagaggagaagggaaaggcggagttgtcaaaagccatgataaaaagagccaacaaacgatagcgtacgatatcaataaaatcaaaagcaaaattcagccaatcgtaaaagggaaaaatatttcattccatgtcgatattgaatcagaaggcgatttggttgaaaactggaacacaaaagaggcgttggacacccagtttatagatcgtctcgaaacgactattgaaaacgaagtaaagaaaatagttggtcaggtattaaaaaaaattcagcgtgattataaagcagatgttgcgggttttgatgaatctttaagacttacatatccccacttatggaaaagggtgaaaaataactgggatgacaccttcagtaaagccgacatcacatacagtgtgaacgtcacaattactcattacggcacggttaaaactcagtaatgaatcccaaggaagagaaggaaacctctcttctcttttttatactttttttggagagatatacacttttcaaatcgaccaatatgctaatataggaattgcttgaaataggagggagaaggggctgtgaggcagaaaccgatttatgtagaaatcgaaatgaaatctgatctggatacactctgggaatatacacaaaacccatcactgcataaggaatgggatctccggttttcaaatattacgtatttgaatagacaaccatgcgaaaaacagaagtttctttacgaaacaagggtaggctttggattaaaggtgtcaggtacaggagaaaccgtcggtgttttcaacaaatgttcatctgaaaggtcttcttcactggcttttggctctaatcatccgttatctctgattcggcatggaagcggctactggaagtatatacagagagaaaatgggaaaatgacgtttttaacacagtaccaatacaaaacagcctacggactgccgggaagatggatcgatcgtttattatttcgaccgctgcttggctgggcgactgcctggagctttgatgcattaaggctttgggtagagcaaaataaacatccgaagcgctttattcgatccgctatcatctatgtgttcatgtgtctgtttttcagcctgttttggttctatcaaggctttgcaggtgttgagacaagcatattggcaggaacagcggagataggcttagctattttgtggctgattcctttaaaaagaaaatggatcattcatggtgtccaggcttgtatttttgctgggtttgcttgtctaggttccgaaatattcatgtgggttctattgagtgtgttttccgctgcaagcggcgctcttagcctgcagctccccagtgccaggcgcacaaaacgaaagagaaagaagtgacattgtgagttcgatttatgaaaaatcaattattaactatcatttgctgcatcccaagctgcagaaacggtaccaattagacgggtctcatacattcagcgggacgggaacgatgtcagaaataagcggaggctcttttctggttagaatgctgttaaagctgggtgtttttttcagatgcttcttttcagaaagaggcaaagacattccatttacaatacaaaatagaacttgtcttttgaaatcacaacatacagggatagaatggaatcgtacatttttctttaaaggcaaaaaacgtttctttgacgcgataatgatatatgacgagaaagaaaatagaatacttgatttcttcggcaaacctcatctgctgttgtctgttttgacgttcgaggcatctcttgacggctctcttacaatcacatcgggaaagcaatggctattgatatttggaaaaagaatcccgttgccgaaatggctgaccggtacatccgtagtttgcgaaacgtttgatgaaaaaaagaattgtttcaccattgaagtgcatgtgcaaaatacaattcttggcactcttttcttttataaaggaacgtttcaggaggaagagagagaatcatgaaacgaaatggcatagtcagtgcgctttgttttataggatttcttgcagcggaagcaccggatatttcagtggcagaggcactcgttttgttatccattctatttttcgtgcctggaattttcccttttgtttttcgtcaatcgccggttcgtgctgctcagtttatggaatatgggctaatccagtgctatccggtagccgcattctttgcggtgctggctctagtgacggaggttggaggtttcgcgctaatctggtggatgtacacagtttttattgcattgtatgcgatcctccgcctttgggaaacaaagatacatagaatcgaagagacatcagttttgttcggtcttatttatttggcgggaggaggattttggttttttgcttatgctgcccatttgcagatcatgcaatttggccctctcatcattttgctgactgctgtccactttcactattctgcttttctgatcccgatcttcaacggcttactcggcagaaccattagaaaacatcggatgttgtatagttggataacatgggtgattttgctttcgccccttcttatcgcactgggcatcacatattcaaaaacacttgatgtcattgcggttagcatttatatggcggcgatttatcttcatgcatttttggtgttcacggcagcttttcgcaccaagacggggacatttcttatttgggtttcttccgctgttttaatgataacgattgctttctcgatgatttattcatttggtgtatttcggcaagaagttacattgaccatcaatcagatgatttggattcacggttttgtcaacgcgtttggtgttatcttgcccgctctcatagggtggagaatagaggatccgaagtcttttgatgcagacagtgtaaagacattcagccgtatctacggaaaaagaaagattggagaagaatttttagctagcattcaagctgaaaataacgctcggtacagcggacttgtggatgatatgggcagcctgcgttcaaaagatttttcaccagaaaaactggcgccgctcattctttcgttttatgaacacaccatcgaatacaatattaaagcaaaagtaacatggagcacgtggtttcggccgcttgcaattgtttacgaatggttcagcagaagaatcggccaaatacatctttcgacgaaccctgattggtataggatgtacagcaagataaaaggtgttcattctaaaaaagacggaagggaaagagtacgtgcctggattagaacaaatgaaaaaaacgaaaccatttttaccgctctttattcagtgtatcgttcaaatggagaggggtatatgaatatttctttaccgcttccattcagcagcatgacaggtattttaaaaccatatcatcatcaggagaagctggttttaacaagcaggcggagaaaaggcagagcgggggatgaggggatttatctgcaaacaagagcgggaacttgtccgcttcctttatctgaaacctttctgatagaagctgtacatgacaacaaattaaccgctgttcatcatatgtggctgtttggaataaaatttctaactgttcattacagcattacacatattaaccagcctattgaaagaacctaacacaaagaagaagcttcgtctgccagttgtaatgagatgaactgttttaaaattctgcaccgcataaagacaggaaaggaagggtttatggtgttttatatcagtttatttctgattctttggctggctgctgggtttgcagtgggaatgaaacaagtgtatgtcgatcagctgtttgataaagctgtgatcgaaagactggaaaaagaagcgaatgatcatggacatgctgaccggatgatcaaacagcgcgtcctttatattgcagcagtgacagtaagcgggtttatttctgtttattatgaaatgaaaacaatcccgcaaaggcgaaacataagaaaaattgaaaaaaacatcatgaaattaaatcaagcaaaaaaacgaagaatgaagaaaaaataaaaagtgcacaggccaaagggcaggtgcatttttgttttgtatggaaaatgggggaggtggtgccagcttacttttcataaattcaaaaatgagaagaacagcgcccgggctaatggtatataatattgtgaatttaacaaaaatttaacaaggaggacgagagaattcgtgctaaagcctcaaagagacctacatcctgttgatttggacttagaggcggagtagatgaaaccggccaaagtatccctgctccgccgtttgctccattccttgaagcatgttgattgtaacatagccaaacgttttccatcaactattaaaattgtaaaattattgtttatttttatggtatttactccgatttcttcaatttatgctgatgatgtatatcagaattttgaggaattaaaaaacaatgaagatccttctgattaccacatttttacgaaagaaaccggaagccctgttcttgttttagctattcacggaggaggtattgaaggcgggacaagtgaagtagcgagagagctcagcaaagagtactcgatgtatttatttgaaggcttaaaatcgacaggaaactcagtcctgcacattacgagcacgcactttgatgaacctcgggcccttaaaatgacgggaaatcatgaatatgtcatttcattacacgggtacgcagaagaagatcagcagatcgaagtcggcggtacagatcgcgtaagagcggcagatttagttgagaaattgcagcatgctggttttcctgctgtattgctcaatacggaccatccgcatgcgggcgttagtccgaataacattgcaaataaatcaaaaacaggtttaagtatccagatagaaatgagcacaggctttagaaagtctttgttcggcatcttttctttaaaaagcagagctgttactcaaaatgagaggttttataagtttacagaagtgatgttccgttttctcaaaaatagctactgaaaaataggaggcgataagacagcctcctattccttatgcttctcattcgtttcgggaaacagctcgtccgcggcttccgtttgatactgtaaggtgttatctctcgctgacagttcatttcggaaattttcatcaagcacatttttcagtaaataccgatgaaaaaagtattcaaaaacagtaagacaggcagcggaaaggagagctgctccaaatggtgagaaatcgtttcttgtttgagttaaaacaaatacccaaagaataacgaatgaaaggccaaagtcagccaatgaagctgtaatattgtttgttctgggtaagacgagcatgtcaccagaaagataggaaacaaaacctaagaaaagtgcaataaacatcacacttaagaaggatgcgtgatagactctgtccaaaatcacatataaaagggcgagagtgaaagcaatctttgaagcaagcgcaatgatatgtttcatttgaccacctaatttgttattttttgaagaaaattcttgggcgtaaacaaatgataaataatgcaattcaaaaccattcataatggtcatgttactattttaaacagtccgtttttgtttacactggtatttttttcagcagtatgaatctttttatgaaaaaagtcgtatatgtggatgatcagctttcaaggggggaatgatttgtggagataaaaggaatcaatcacttgttattttcagtttcgcatttggatacatcgattgatttttatcaaaaagtgtttgatgcaaagcttttggtaaagggaagaacaactgcatattttgacatgaacggcatctggctagcgcttaatgaagaaccagacatcccgagaaatgacattaagctttcttatacccatattgcttttacaattgaagatcatgaatttgaggaggtatcagctaaattaaaaagacttcatgtcaatattctgcctggcagagaacgagatgaacgcgatcgaaaatcaatttattttaccgaccctgacggccacaaatttgaatttcataccggaacacttcaagacaggcttcgatattacaaacaagaaaaaacccatatgcacttttatgatgaaacggccttttgatatcacacaccatatttcatataaggttaaatttaaagaagggtgttggtggagactttatgtttggggaaggtttctacccgattagttcaacgatgccatatcttttgaactgcacaagtgattcggtgaaggagaatttgaaatacatattacattttatatgaagaaagcgagctgttttaacagagtgttgaactacctaaactatgtactaaattttcagttatatcaattgcctcgccctttaataaatataaaaccgcatccttccacgacctaaaaatgaaacgtttttaagaagatagcgtctaatattctaaacgttcatattttgaataaaagtttcctgaaggaaagaaaatttcttgaattcaacaattgtttggtggataattatggtgtaaacatgatgttctttttcctcctattcaggctcgcacccaaaagtcagggcgagcctgctttttttgaacaacaaaccccctctccgtaaaggaaaagggggttatttcatgcatctgatagatcaatagattaatggacggttctgaacacgccaatcactttccctagaatgctgacattctgcaaaatgataggttccatcgttgggttctcaggctgcaagcgaatgtgtgtatcctctttatagaatcgttttacagttgcttcatcatcttctgtcatcgcaactacaatttccccattgttcgctgtgttttgctgtttaacgatgacatagtccttatcgagaataccagcatctatcatactgtctcccataatctccagcataaatacatgctcgtctggaggaaccatgcggtcagggagcggaaaatattcttcaatattttctactgctgtaataggagatcccgccgtgactttcccgatgaccggtacattaacgacctggctttgcggaatgtctacttcttcatcaagaatttctattgctcttggttttgtcggatcccgtctgatcagcccttttgtttccaagcgggccaaatggccgtggacagtagagctggacgcaagcccgacagcctctccgatctctctcacggaaggcggatatccttttgatttaacctctgctttaataaaacggaggatatcaagttgcctttttgatagcttcgtcatttttcgcacctcaaaacgtcgattttaagaagattatagcatgattttccttacagtacaaacataggttcgaaaaaacaattgacagaaacatttgttcgtatatactgaaattataaaaatgcgaacaaacattcctgttggaggttatgatcatgagtaaagaatctattatttttgtcggtctgttcacagtgattttgagcgcggttatccttatgctgtcatatacaagcagcggccaagagcttaatcagtatgttaaaatagaagtccagcaaggcgacacactctggtcaattgctgatcaggtagcagatacaaaaaagataaacaaaaatgattttattgaatgggtagctgataaaaatcaacttcaaacctctgatatccagccgggtgatgagttagtgatcccattgaaaaagaagcatcaggatgcatatgaattggcaactgtaaaatagagaggaaagagagataaaatgaaagcactcatttatgcccgtgtaagcacaaataaagaacagcaggaaacgtcattaaagcggcaggaggaggagcttacggccattgcagcggagaacggcatggaagtggtcaaagtgatttcagaaaaagccagcggatatgaaatggatcgggatggtgtatttgagctgcttgatgagattaagaacgctggaattgatgtcattttggttcaggatgagacaaggctcggacggggaaacgcaaaaatcgcactgcttcattgtatttatagagaaggtgtgaaagtctatacaacggctcatagaggtgaactggagttatcggaggctgactcaatggtcttggaaatcgtcagcattgtggaagagtatcagcgaaagattcacaacatgaaaatcagacggggaatgaagcgtgcagtaaaaaacggttttaaaccgcaaaaaaacttaaaaaaccaacatgggaacagtggaaaagaaaaaatagaggtgccaatctctgagatcgtccgcctgagagcgaataaactgacgtttgctgaaatcgcggctactctaagagggtttggctatgatgtctctaaagcaaccgttcaccggcgttttcaggaatacatagagaatgaagagacagcagagtgaatcagttgtaaaactttttttgatctagtactatatagacaaaatgcaataaaggagtttaacatgatttcaaacgcgaaaattgccagaattaatgaacttgctgccaaagctaaagctggcgttattacagaagaagaaaaagcagaacagcaaaagctccgtcaagagtatttgaaaggttttcgttcttctatgaagaacacgttaaaaagcgtgaaaatcattgacccagaaggcaatgatgtaacaccagaaaagctaaaaagagaacaaagaaataacaaacttcactaatataagaggaatacggcaatatcgtattcctcttttgcatatactataatcaaaactcttatgtgacaaaattcaacaagtttctctcaaatttaagctgaaacagttgagaaaaagtcgtcagacatttatgatgtaagggtacaacacataaggaaggggatttttatggatacaattgaaaagaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacaccaggacatccggaattcggacatactgccggtgttgatgctacaacaggtccgcttggccaaggaattgccatggcagtcggtatggcaattgctgaacgccatttagcggaaacatacaaccgcgattcatttaacgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaagcaatgaattgggaagttctttatgttgaggatggaaacaatattgaagaattaacagcggctatcgaaaaagcacgccaaaatgaaaagaaacctacattaattgaagtgaaaacgacaatcggattcggttcacctaaccgtgccggtacatccggtgttcacggtgcgccgcttggtaaagaggaaagcaaattaacaaaagaagcttacgcgtggacatatgaagaagacttctacgttccgtcagaagtttatgatcatttcgctgcagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagcctggcatcccgtgcatcttccggtgaagttctcaacggacttgcgaaaaaaattcctttctttgtcggaggttctgctgacctagcgggatcgaacaaaacgactattaaaaatgccggtgattttacagcggttgattactcaggcaaaaacttctggtttggtgtacgtgaatttgcgatgggtgcagccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggttggtgaagacggtccgacgcacgagcctgttgaacagcttgcttcactccgtgcgatgcctaacctttctttgatccgtccagcagacggcaatgagacagcagcagcatggaagcttgcagtgcaaagcactgaccacccaacagcgctagtgcttacacgtcaaaaccttcctaccatcgatcaaacatctgaagaagcattggcaggagtagaaaaaggtgcatatgtcgtttctaaatctaaaaacgaaacacctgacgctcttctcatcgcttccggatcagaggtaggtcttgcaattgaagcgcaggctgaattggcaaaagaaaatatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacggggcttgaaggtgacgttctcggcatagaccgattcggtgcatctgctccaggtgaaaccatcattaacgaatacggcttctcagttccgaacgtagtgaatcgagttaaggcattaatcaataagtaagcttttgaaagaggatgagtcaaatcatcctctttttcttgtttatccgacaaaaatagtattggcggtttaacagtaatagacaattctttcttttcttcttttgtataatagagagcaaatgaaatgctgctggaaaaggggatgaaaagatggaacgtcactactatacgtacctgatcaaagaggaatttgccaatcactatttcggccgggaatcggttatgtttgagctgtttcaagactatcattggacaagccttgaaaagcagcagtatgaaatgacagagaaacagattcaatatattacacaaccaatcccgattttacatatgcatcagcggttaaaaatgaatttaaacaagacggattacaggcagctggattatatttatagaatagctttgccgaaagcaaaaggccacgcgacgtttatgatgaaggagcacatgatagaaattgtggcttcgggagattacgaggcagaaacgatattctttgaagtgttaagaaaagttagcccttgctttttagcaatggatttcaattcgaagcgttacggatggctaaatccggtgaaagaaagaaattttgtctaaaaccgaagaaaaagagatgtaaatgttgtataatagcttttggtttagtacactttaaactagacaacatgaaggaggaaataaaatgactttatgggttggcatcctagtgggcgttgttgcattgctcataggtgttgcactcgggttttttattgctcgtaaatatatgatgagctacctgaaaaagaatccgcctattaatgaacaaatgttacgcatgatgatgatgcaaatgggaatgaaaccttctcaaaagaaaatcaatcaaatgatgaaagccatgaataatcaaacgaaataatacgtaaagattatgatatagagaaacatggttataaaataaaaaacccttatacgggttttttattttgcaatcattcatcacccgctactgctcgaaggcgctgcttttgatattgtatgagaagatggtcaagctcctgactgagctctatcgtaatatgagatgtcattccgttcgccatgacaatttgcagcagctctgctctttttttttcaatttcttttaatagatgctctctaatcacagggatgtatcctttcatacattagatcttcaaagtgaatgtttatattatatccatatttatactaattttcaaatgagaaggagtataatgtctcaatgtcaaattaaattatataagttttttctgaaaatagaaatccttcaagtgaaagtgttaaaaaaatgaaatgattttgtcataacttgaaggaatgtcaaatcatgaagggatgatgacatgggagacgtgaattattttttgacattcggagcggggtttttatcctttatttcgccttgctgcctgccgctttacccagcttttttgtcatatattacaggggtcagcatggacgatgtaaaaactgaaaagctgctgctgcagaaaagaagcttgtttcatactttgtgttttttgcttggcttttcagtcatttttattgctttaggctatggaacatcttttattggcagcctgtttagggattatcacgatgcgattcggcaaattggcgcgttgtttattattttgttcggtttcattacactcggtgtgttccggcctgaggctatgatgaaagagcggagaatccattttaagcataaaccaagcgggtttttagggtcggtcttaatcggaatggcatttgcagctggatggacaccatgtaccggtccgatattagctgctgttatcacacttgcaggcaccaatccgggctcagcggtgccatacatgatgttatatgtactcggttttgcggtaccgtttcttttattgtctttttttatcacaaagctgaagtggataaggaagaaccagcttttcattatgaaagctggtggcgttttgatgattgtgattggtgtgctgttattctttaattggatgagcctgatcattattttgctgtcagatctttttggaggctttactggtttttgacggtaaattactttcgtactactactaatccttttgtttttggtacaataagactattatctgtggaaatcgattgttggaggggaatatgacaagagttttagttgtagacgacgccaagttcatgagagtgaaaatcagagagatcttggaagaggcaaattacataatcgcaggcgaagcggcggacggtgaacaagcagcggacctgtataaaaaactgcgcccggaccttgtgacaatggatattacaatgccggtgaaaaacggcataaaagcgcttcgtgatatcttaacctttgatcctaaagcgaaggtcatcatgtgcaccgccatgcgccagcaaagaattgtaacggaagcaattgagctgggggcaaaggattttattgttaagccgtttgaggaaacaaaagtgctggaagctgtaagccgcgttatgggacattaaagtcatttcttttcaaaatggttttttttattgttttggagtatagtatatagtatcaacactccgagaaacaaaggaatgataagtatgatgattatagtttcatcgattattgctgtgttaatggctgtagctgtgatggtggtcagaataaagtcctctgacaagcctgtttcaccaaaaaaaatcattcttccgccgatttttatgagtacgggagcgttaatgtttttatttccggtattttgggtaactggtgcagagtttttggaagcattcactttaggtgtgattttctctatttttctaatcaaaacttctaagttcgaaattaaaaataatgaaatttacatgaaacgctctaaagcatttgtttttatattagtcggtcttttggtgatcagaatcgtgatgaaatcgatcttgagcacatcaattgattatggtgcactgagcggaatgttttggattctggctttcggtatgattgtgccttggagaatcgccatgtatttatcatatcgaaaacttcataacgagctgcagtcatctaatattcaaatgaattaaaaaacctttcctcttgtcaggaaaggttttttatttgagaagggtctgataaggttccaaatcgatttttttgtcccgcagatgcctttttaagaaggtatggtctcttttaggagttgcgagaatatagcctttgatcataagttgctgatcaatctttgctaccttttcttttattgcaagctcaccgattttgcctgcgattttggcttttgctgcatctctgaacagctctggcaccggcgcagtcaattcatctagaaactgtttgttttcatcgttccataaatgtctgctgttttcaatatagtaatcctgccaatcaagctctgatctgccgtcctcttttggtaaacgctttaaaaactttcgaaacatgaaaaaaccgccgattgataataagactaccatcatgatcacccaaaacagaataaaccataaaaaccatccttccagcatcaatcattcccccttattctaaccatattgtatacgaagagagattagaagaacacagtaaaaaaagaatagaaaaaagtgatagacgtctagtcaaaagagatagtagatcatattctattgtatagtgaatctgctatttggccatgggagagtcactagagggtatttgacgataaatggacggaaaaaaaagtcactttcataataggggatgaaagtgactttttatgtttagctgagaggaaattgaagagaaaaagaagagccatcttctgtttctttattgacggcgactgtgagtatttgattttcgcattcggcttgaattgttttgtcattaaaataaaaaggaagcatcatttgtttttcaaaagtctgtcctgacgatttgacagttaagatgaactcgcatccagaaagggtaactgttacttgtgtaggctgtaaaaaagtcagatccgcttctataatatactgctgactagtttcatataaatcaataggcaatgtttcgtcgtaccaggcgaaggggtcttcaaaaaattgccgaagccattcatccatactatcgaaatcatttgcatcgttgcgttttgaatggtccatggaagcattcctccacatatcaaccttgcttaacatcatatgcggtggattataaatgggtgaacgcataaaaaaacagacactaaggtctgcttttcttacatatcatggcttgagttgtgcttttgtcttgtatggtttcggttctttacttttttgcttccgcttagaggctcaggttggccgggattgtgtcctttgggggcgtttttatgcatatctttacttgtattcttattggtcataaaatgagaacctccttaaaagagttcggtgttattgattggtttttctttttttgttattttggcgttctgcttcagtcagtacaagctggtcgttttcaatatagccggcgcctttgccttggctttttgcgtcattcattccgttaatgacgtgattcgcttttcttttgaccatcattatcacctcaatcataatatggctccttttattgtgttatatgagagagcgtaaacagtaaaaattaccggtacatttttctcataagtcgaacttattgtatttaataaaaacattgatatttacttatgtatgattttgttttaatatgaaattgtgagaaaattgtgatggaatgtaatgttcatctgagaatgatctgatctgaagggggattttggagaatggcaaacgagcaaaaaactgcagcaaaagacgttttccaagcgagaaaaacgtttactacaaatgggaaaacatatcattactactctttaaaagcgttagaagattcaggtataggaaaggtttcgaagcttccttattccatcaaagttcttttagaatcagtattgcgtcaagttgatggcttcgttatcaaaaaagaacacgtggaaaatttggcaaaatggggaactgccgaattaaaggatatcgacgttccgttcaaaccgtctcgtgttattttacaagacttcacaggggttccggcagtagtagatctggcttcactgcgtaaagcaatggcagctgtcggcggagatcctgataaaatcaaccctgaaattcctgttgatctcgttatcgaccactctgtacaggtagataaagctggtacagaagatgcattagcagtaaatatggacttggaattcgaaagaaatgcagagcgctacaaatttttaagctgggcaaagaaagcgtttaacaattatcaggcagtgccgcctgcaacaggtattgtgcaccaggtcaaccttgagttcttggcaagtgttgtccatgccattgaagaagacggcgagcttgtaacgtatcctgatacgcttgtcggaacagactcacacacaacaatgattaacggtatcggtgttctcggctggggtgtcggtggaattgaagctgaagcgggaatgcttggacagccttcttacttcccagttccagaggtaatcggcgcgaaacttgtcggcaagcttccaaacggaacaacagctactgacttggcgttaaaagtaacacaagtgctgcgtgaaaaaggcgttgtcggtaaatttgttgaattcttcggaccgggaattgctgaactgccgcttgcagatcgcgcaacaattgcgaatatggctccggaatacggtgctacatgcggattcttcccagtagatgaagaagcgcttaactacctgcgcctgactggccgtgatcctgaacatattgatgttgttgaagcatactgcagaagcaatggcttgttctacactccagatgcggaagaccctcaatttactgatgtggttgaaattgacctgtctcaaattgaagcaaacttatcgggtccaaagcgtcctcaggatttgatcccgctatctgctatgcaggaaacgtttaaaaagcacttagtcagccctgcaggtaaccaaggattcggtttaaatgctgaggaagaaaataaagaaattaagtttaaactccttaacggtgaagaaacagttatgaaaacgggtgcgatcgccattgctgcgattacaagctgtacaaatacatcaaacccatacgttctgatcggcgccggactggtagcgaaaaaagcggttgagttagggcttaaggtgcctaattacgtgaaaacgtcacttgcaccgggttctaaagttgttacaggatatcttgtgaattcaggccttcttccatacatgaaagagcttggctttaacctcgttgggtacggctgtacaacatgtatcgggaactcaggcccgctttcaccggaaattgaagaagcggttgcgaaaaatgatcttctgattacgtctgtcctttccggaaaccgtaactttgaaggacgtattcacccgcttgttaaaggcaactatcttgcttcaccgccgcttgttgtggcatatgcgctggctggaacggtaaacattaacttgaaaactgatccaattggtgtgggcaaggatggtcaaaacgtatactttaatgatatttggccgtcaatggacgaaatcaatgcacttgttaagcaaactgttacgccagagctattccgcaaagagtatgaaacagtatttgatgacaacaagcgctggaacgaaattgaaacaacagatgaagctttatataaatgggatagcgagtcaacttacattcaaaatccgccattcttcgaagaaatgtctgttgagccaggcaaggttgaaccattaaaaggtttgcgtgttgtcggtaaattcggcgattcagtcacaactgaccatatttctcctgcgggggcaatcggaaaagatacgcctgccggaaagtacttgcaagaaaaaggtgtttctcctcgtgactttaactcctacgggtcccgccgcggaaaccatgaagtcatgatgagaggaacatttgcaaacattcgcatcaaaaaccaaattgcaccgggtacagaaggcggatttacaacgtactggccgactggtgaagtaacatccatctatgatgcgtgcatgaaatacaaagaagataaaactggtcttgttgtattagcaggaaaagactatggtatgggatcttcacgtgactgggctgcaaaaggaacaaaccttctcggcatcagaacggtcattgcagagagcttcgaaagaattcacagaagcaaccttgtattcatgggtgtgctgccgcttcagtttaaacaaggtgaaaatgcggatacactcggcttaacgggtaaagaagtcattgaggtagatgttgatgaaacggttcgtcctcgtgaccttgtgactgtaagagcaatcaatgaagacggcaatgtaacaacttttgaagcagtcgtccgctttgatagtgaagttgaaattgattactaccgccatggcggcatccttcaaatggtgcttcgtgaaaaaatgaagcagtcctgatgaatcaataggaagagaaggcatttcgctttctcttctttttatgacacaatgtgctgcggaggtggcatatgctgaaaaaatggctcgcagggatcctgcttatcatgcttgccggttatacgggatggaatttatatcaaacatacagcaaaaaagaagtcggaattcaagtggggaaacaagcacctgatttttctttgaaaacgctgtcaggagagaaaagctctttacaggatgcaaaaggcaaaaaagtgctgctcaatttttgggcaacttggtgtaagccgtgccgtcaggaaatgcctgcgatggaaaagttgcaaaaagaatacgccgacaaacttgcggttgttgcggtaaatttcacttcagctgagaaaagtgagaaacaggtccgagcgtttgctgatacgtatgatttaacgttcccaattctgattgataaaaaagggatcaatgctgactataacgtgatgtcatatccaacgacatatatcttagatgaaaaaggtgttatccaagacatacacgttggcaccatgacaaaaaaagaaatggaacaaaaactggatcttgattagattcagttttttttatgctcagatatgcttacaagttttcagaattggaaaaaataaaagaatatgcggaggtgaaaagcgtgaagaagatgagaaaacgttcttttcatgagctcgtcatggaaaacaaaaaagagctgatgaccaatacagagtttttaaatcagcttgaggaaaagcttgaacagcgatttaagcaaaaataacctttaatttgtattcatgtttacccctccttttgagaaacctatctgttgaggagggataaacatgggaaacaacaagaaaaacggtcagcctcaatatgctccaagccacttgggtacaaagcctgtaaaatataaagccaataaaggggaaaaaatgcatgatacttcaggtcagcggccgatcatcatgcagacaaaaggcgagtagcgaaaaatcgagtttatttctaggaggtacatccgaatgacaaagaaccaaaatcaatatcagcagcctaatcctgatgatcgctctgacaatgtggaaaaattgcaggatatggttcaaaatacaattgaaaatatagaagaagcagaagcatcaatggagtttgcttcaggagaagataaacagcgtatcaaagaaaaaaatgcaagacgcgaacagagcattgaagcgtttcgtaatgaaatacaggacgaatctgcagcgagacagaacggataccgttcttaaaaaaccagggaaacctggtttttttctttctgatttgattatggtaaaatggggctaaattgacgttaagggagcagagtaatcttgcatgtatcaaaaaaagaaatagaagtgcgttatgcagaaacagatcaaatgggaattgtctatcacgcaaattatcttgtgtggatggaggtcggcagaacggccttaattaaggacttaggctttttatatagtgatatggaaaaaagaggcgttctgtccccagtcgttgatatcaacatttcctataaaaagccgcttcattacggagaaaccgcggttgtacatacatggatagaggaatataacggctttaaaaccgtctatggttatcacatttataatccggccggtgagctttccatcaaagccacctcatctcatatttgtgtggataaagaaagctttaagccaattcaattccgcaaagcttttcctgattggcacacagcatatgaaaaggccaaaaaatagggaagtgaacgggatatggcgtttggtgtgaaacgggaggaacttaaccggtggaaacaagcagtgaaaagaggagaaatcgcatttttaacacattactggctggatgaccgatttccagaagcaaggactgtgacaaaagccggctgtgcagacattgataagctggttcagtggggagcggcgtacgggttaaaaaaagaatggatccataagaaaagtgaatttcctcactttgatctgctgggtgaaacacaaaaatatattttggaacaagaaaacctaaccgatcatcttatacgatttcatttgtaaaaaaagaacgcacatgatgtgcgttcttttttattggtattcaaaaaccggttcatcagcgtcttctgaatagctgacgagaaggtcgtggttatcaaagtaccataaatcactttcttcaataaagaaggtaatgccgtcagcttctgcagtgactccagcctcttgtggggcatctttcgctacaccgagagaaaaacccttttgaacgttgctgcagcctccatagcgcacgaaaaagcgaacctggtctccgctttccaaatcgagttcttctttataccagttcaatgcgtcttcgttaattgtcatattcataacagaacacccctttgttcttcatttgaattttctctattataaacgtattaggctattctgtgtcaaaagagaagttttttaagcttataaccattttactttaggttctgttttattgataattcgtttaatgttcgctcggtgtctgtatatgacaaaaatagtgagcagggtaacgacaatcaataaatacgtatcatggacaaagaaactatatataacagtatagatccctgttaacatcgatgagagagaaacaaatttagtcaagtataaaaagatgaagaataccgcaaccatcgtgataaataacaggggtgcgtaaaacagcaaaacgcctcctgatgtcgccacggctttaccgcctttaaatttggcgaagatgggaaacacgtggcctaaaacagcaaagactcctgcaagaagcgggtgaatatcaacatgcatgagaaaaggcaatgcagttgccagtgtccctttcaaaatatctccggctatgacaaccgaaccagcttttacacccaatgtacggaatgcattggtagcgcctaagttgccgcttccgtgctcccgaatatcaattcccttggcaagcttgcccacaattaagccagatggaatgctgcctatcaagtaggccaaaataatcaataaagcaattaacatctacatttctcctttttcaaattcccttctttttattttaacatgagatgtcatgatctgatgataagtttttttgtaaagtttgcttacaaatccaatcaaacatgcatcatattttgatttctcctgttttgatcgtgtaaaataagtggaaaaggagtgacatacgatgcaaaacccttctaaagcggaaattaaagagattcttcaaagaagcaaacgtatagccgtagtagggctttcagaccgtccggatagaacgtcacatatggtttcaaaagcaatgcaggacgcgggttatgaaattatccctgtgaacccgacaattgatgaggcgctaggtgtcaaagccgtttcatctttaaaagagattgacggtccgattgacatcgtaaatgtattccggcgctcagaacagcttcctggagtggcggaagagtttttagagacagatgcgccagtattttgggcacagcaagggctagttaatgaggaagcataccagatgctaaaagaaaaaggcagaacggttatcatggatctgtgcataaaagtggcacacgctgtaacaaaataggtgcagaactgcaaaaatccttgtaaattcaaggatttttgctttttaattttaagatattgtttgcgtattacggtgaaacagatacaataaagcttgaacagctttttttgaataccttgtccagctgggtttggccgttcgatttgcgaaggtctgctgctttatatataataaacaaacatacgttctcatagtgtaaatacagcactagccgatgttttgagaagaactgattcgttagctctatgttgcgattgcaaacatattggttataatgaggagtccaaggcagtactggctcgaggcgaggtttataaaaaatatcttatatacaaatgatgtgtaacactgaaaaagagaaagacaatgttagtttttgaaaggggtttgtacgtttggctagaaaacagcaatttgattacaacgaagatgccatacaggtgctcgaaggccttgaggctgtcaggaaaaggccgggtatgtatattggctctactgacgcgcgaggtttgcaccacttggtttatgaaattgtagataactctgtcgacgaggtgcttgccggccatggagatcacataatcgtcaaaatacataaagacaatagtatttctgtacaggatagaggccgcggcatgccgaccggaatgcataagctcggcaaaccaacccctgaagtgattttaacggtgcttcatgccggaggaaaattcggccaaggcggctataagacaagcggcgggctccacggagttggtgcatcagtcgtgaatgctttatctgaatggctgacggttaccattgagcgggacggttttgtctatcagcagcgatttgaaaatggaggaaaaccggttacatctctcgaaaagatcggcaaaacaaaaaagacgggaactcttacacactttaagccagatccaacgatgttcagcacaaccacttataattttgaaacgctctctgagcgcttaagagagtctgcgtttttgttaaaaggattgaaaattgagctgattgatgaacgcaatgaccagcatgaggtcttttattatgaaaacggcatagaagcgtttgttgcttatttaaatgaagaaaaagacgtcttgtctgaagtggtctcgtttgagggtgagcatcattctatagaagtggactttgcgttccagtttaacgatggttattctgaaaatattttgtcgtttgtcaacaatgtcagaacaaaagacggcgggacgcatgagtcaggtgcaaaaactgcgatgacgcgtgcttttaatgaatatgcacgaaaagtggctttgctgaaagaaaaggataagaaccttgaaggcaccgatataagggaagggctttcagccattatttctgtccgcattcctgaggagcttcttcaatttgagggacaaacaaaaggaaagctcggtaccagtgaagcaagatcagcggttgatgcgattgtttcagagcagcttgcttactttttagaggaaaatcgggacaccgcaacgcttcttgtcaaaaaagcaatcaaggcgagtcaggcgcgcgaagcggcacgcaaagcccgtgaagaagcaagaagcggcaaaaaacgaaaaaaatcagaagcgactttaagcggaaagctgacgcctgcgggttcaagaaacccggcaaaaaatgaattgtatctcgttgagggagattcagcaggcgggtcagccaaacagggaagagaccgcagattccaagcggttctgcctttacgcggtaaagttattaatacagaaaaagctaagcttgctgatatctttaaaaatgaagagatcaatacgatcattcatgcgatcggcgggggagtcggagcagatttctcaatcgatgacatcaactacgacaaaatcatcattatgaccgatgccgatactgacggcgcccatattcaagtgctgcttcttacctttttctatcgctatatgaagccgctcattgagcatggcaaggtgttcattgcgctgccacctttatataaggtcagtaaaggaagcgggaaaaaggaaatcattgaatatgcatggtctgatgaagagatgggtgatgtcctgaaaaaagtcggcaaaggctataccattcaacgatataagggtcttggagagatgaacgcagaccagctgtgggaaacgacgatgaatccggagtcccgcacacttgttagggtcaaaattgacgatgcggcacgtgtagagagacgtgtaacgacgttaatgggagacaaagtagagccgcgcagaaagtggattgagaaaaacgtcgctttcggcttagatgaagaaagcaatattttagaaaatgaaaacttatcggtcgctgaggaggtttaatgattgtcacagccagaattatttcatgatttaccattagaagaggtgatcggcgaccgttttggacgctacagtaaatatattattcaagacagggcgctgcccgatgcgagagacggattaaagccggtacagcgcagaattctgtatgcaatgcatacagatggaaacacgtttgataaaaacttcagaaaagcggccaaaacggtcggtaacgtcatcggtaactatcatccgcacggtgacagctcggtttatgaagcaatggtgcggatgagccaggattggaaagttcgtaatgtgttaatcgaaatgcatggaaacaatggaagcatcgacggagatcccccggcagccatgcgttatacagaggcacgattatctccgattgcatctgagcttcttcgggatattgacaaaaacacggttgaatttgtgccgaacttcgatgatacaagcaaggagcctgtcgtactcccggcgatgtttcctaacctattggtcaacggatctaccgggatttcagcaggatacgcgaccgacattccccctcatcatctgggagaagtcattgatgctgtcattaagcgtattcaaatgccatcttgttctgttgatgaactcatggaagtcattaaagggcctgattttccgacaggcggtattattcagggcgttgacgggataagaaaagcttacgaaaccggaaaaggaaaaatcattatccgcggaaaggctgaaattgaaacaatcagaggcggacgagaacaaattgtcattactgaaattccatttgaagtaaataaagcaaaccttgtaaaaaaaatggacgagttccgtattgataaaaaggttgaaggcatctcagaggttcgtgatgaaacggatcgaacagggctgagagtggtcattgaactgaaaaaagaagctgatgccaaaggtattttgaatttcttatacaaaaatactgatttgcagatcacatataacttcaatatggtggctatccataaccgccgtccgatgctgatgagcctgccgtctattttggatgcatatatcggacaccaaaaggaagttgtcacaaaccggtctgtttacgagcttcaaaaagcaaaagacagacatcatatcgtagaagggctcatgaaagctttgtctattttggatgaagtgattgcaacaatccgttcttctagcgataaacgtgacgctaaaaacaatttgatcgcgaaatatgaatttacggagcctcaggctgaagccatcgtgtcattgcagctatatcgtttaaccaatacagatattacagcgcttaaggaagaggcagaagagctcggtaaaaaaattgaagagctcgaatctattctgagcaatgataaaaaactgctaaaagtgattacaaacagcttaaaagcattgaaaaagaaatatgcagatacgagacgctccgtgattgaagaaaaaattgaagaaattaaaatcaatctcgaagtcatggttgcatctgaggatgtatatgtaaccgttacgaaggatggttacctaaaacggacgagccagcgctcatttgccgcttccaacggacaggacttcggaatgaaagatacggacaggatgctgcatcagtttgaaatgaatacgacagacgtgctgctgctctttacgaacaaaggaagctacatctattgtcctgttcaccagctgcctgatatcagatggaaggacatgggccagcatttttcaaatctgatcactattgaccgtgatgaaacgattgtaaaggccataccgataaaagaatttgatccgtcggcatatcttctattctttacgaaaaacgggatggtgaaaaagacagagctcacccattataaagcacagcgttattctaaggcgcttgtggccttaaatctgaagggtgaagatgaactgattgatgtacatgtaacaaatggggaaagccagatctttatggccactcacttagggtacggcctatggtttggagaagacgaagtgaatgttgttggcgcgcgtgcggcaggtgtcaaagggattaacttaaaagaggatgactttgttgtctccggtgagatccttcaacaatctgattcaattgtcttgttcacacagcggggagcggtaaaacgcatgagtctttctgagttcgagaagacatcccgcgcaaaacgcggtgtcgtaatgctaagggaactgaaaaagaatccacaccgagttgtagcactgttcgcttgcggtcttgaacagcgactaatggcagaaacagaaaaaggcgacagaaaagaactgcaggcaaaagagttgcggacaaacgacagatacagcaatggctctttcttttttgatgaagaggaatcaggtaaggttacagctgtttggcgccttcatacagaacaataataaaaaacccgctcatactatatgagcgggtttcgtttgttttttatcagctttcatggttggtgaatagatctgttacagcatgaatgacttcaatcccctgccatacaaataaattcagcgctgtgaaagaaaataagcctaaaatcaccattcttaagataaacaacatgtttaacagcctcctcatattttcgttacataatcgggtgatgttgaacatgaagtttgccgaaataagacgattgataaaatttggccagtataaagctttttttccgctgacgtctgcgggagtatcccgtacttttgctttcagcggtcagcagcagaacagccattgcccataaagcggtcagtgtaaatgcccctgtgatggatttcttctcatcatcagcattttggccggctttcatttcatgcatttcctgctggtcggctacggctttataatgatggccgatatcaaaggcgtggggaattgagagcaaatgaaaactggcaatcgccaagaataagatggatgctttcaatatcgttacttttttcaaatgatctccccctcctttaatattactgaatatttttataataataccccaatccatcctaaaagtaaacctgatttattaaatttaaaaataaatttaactttgttaagtatatatctttttgcttatttttgaaagagaaaacttcttttattagcgtatgtatacccggtttatggtgtgaataaaaacatattttaaatgatatgtttgttgtttaggatttattactttatttatgtgtaaatcaaagagaaaggcaagagaatgggaagaaatgattacattgttaatagggtactctttttttaaagccagcttgcaaggaatgtttttattcgtaggaaaataatagagaaggggtcgacagagtaacatctggctatgacaatattcttctcgaaaaaacttcctaattcgtcatattgtgatataataaaactcgttatgttaaaaaatctaacatcaaaatcgaattcgtattgaattgatgaaaacgggaggtaaatatggagtcttttttcaatagtttgattaatattccaagtgatttcatctggaaatacctattttatattttaatagggcttggattattttttaccatacgttttggttttatccaattccgttattttattgaaatgttcagaatagtaggggagaagccggaaggaaataaaggtgtttcatctatgcaggcattctttatttcggccgcatcccgagtcggcacagggaatttgactggtgtagccttagcaattgcgacaggcggaccaggagctgtattttggatgtgggtagtggctgcagtaggtatggcttcaagctttgttgagagtacgttagcgcagctttataaggtgagagacggggaggatttccgcggagggccggcctactatattcaaaagggtcttggtgccagatggcttggcatcgtttttgcaatcttaattaccgtctcattcggcttgatttttaacgctgttcaaacaaatacaattgctggagcattggatggcgcattccatgtgaataaaatagttgtagccatagttctggcggttttaactgcgtttatcattttcggcggtttaaaacgtgttgtcgctgtttcacagctaattgtgccggttatggcaggcatttatattcttatcgctttatttgttgtcatcacgaatattacggctttccctggcgttatcgctacaattgttaaaaatgctttaggttttgaacaagtcgtcggcggcggaataggcggcatcatcgttatcggtgcgcagcgcggactgttttcaaacgaagcaggaatggggagcgcaccaaacgcggctgcgacggctcatgtatcccatccggcaaagcaaggctttattcaaacattaggtgtatttttcgatacatttatcatatgtacgtccacagcatttattattttgctgtacagtgtaacaccaaaaggcgacggtatccaagtaacacaggctgctcttaaccatcatattggaggctgggcgccgactttcatcgcagttgcaatgttcttgtttgcattcagttcagttgtcggcaactattattatggcgagacaaacattgaatttattaaaacaagcaaaacatggctgaacatttaccgtatcgctgtaattgctatggttgtgtatggatctttatcaggcttccaaatcgtttgggatatggcggacctctttatgggtatcatggcgctgatcaacttaattgtgattacgctgctgtcaaacgttgcttacaaagtgtataaagattacgcgaaacagcgtaagcaaggacttgatcctgtgtttaaagcgaaaaacatcccagggctgaaaaacgctgaaacatgggaagatgagaaacaagaagcataatataaatataaaacaaagctgcattcaatagttgaatgcagctttttcattattggaaataaatttaatttttcgactcgaatgaaaaatgacgtgtaaagtcccaattcagtccagttttctttgttctatatgtgtcatgtgtgtcttattcaatggagatagagtaaattgacaggcttttaaacctcacaaaaacaagaaattaggttgatagacaatcatgagaaagatttttacaatgagttcgtgctcataagaagttgagagccaaaatgatgcgaaggaggaaaagatcagatatgaaacggtcaatctcgatttttattacgtgtttattgattacgttattgacaatgggcggcatgctggcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagggacgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagtctttacggaaacacgccaaacgtcatttatgaaattgcaaacgaaccaaacggtgatgtgaactggaagcgtgatattaaaccctatgcggaagaagtgatttccgttatccgcaaaaatgatccagacaacatcatcattgtcggaaccggtacatggagccaggatgtaaatgatgctgccgatgaccagctaaaagatgcaaacgttatgtacgcacttcatttttatgccggcacacacggccagtttttacgggataaagcaaactatgcactcagcaaaggagcgcctatttttgtgacagaatgggggacaagtgatgcttccggaaatggcggtgtattccttgatcaatcgcgggaatggctgaaatatctcgatagcaagaccattagctgggtgaactggaatctttctgataagcaggaatcatcctcagctttaaagccgggggcatctaaaacaggcggctggcagttgtcagatttatctgcttcaggaacattcgttagagaaagcattctcggcaccaaagattcgacgaaggacattcctgaaacgccagcaaaagataaacccacacaggaaaacggtatttctgtacaatacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttgggtttaaaaacggaacgctggcaccgggagcaagcacagggaatattcagctccgtcttcacaatgatgactggagcaattatgcacaaagcggcgattattcctttttcaaatcaaatacgtttaaaacaacgaaaaaaatcacattatataatcatggaaaactgatttggggaacagaacccaaatagtttaacttttggcgggcatcagcaatgatgtccgttttcattatcttatccagtaaaacaaggaggtttgcgttgtggatgaaatactgaaacagtatatggtgctgtacaaaaaaatgagtaatatgataaatggtccggactatccaggtaaggaaaaagacatccagcatcaaaaagatcagatcgaagtttacgaaaaacagctgcagcaaggattttctacagattatgactatgatgtgtttgctgattctgttatcaaatgcgcatatggcgatatgacgctggaggatttagaagccgtttattatggattgacaacaccatttttttgatttgtcagtcagcagtaaaatttcaaaatttcaatttctgtctcactaacttaagtatactttgatattgagacagaaatttatttattttctttacttcctagaatatatattatgtaaactataaaagatgaagattaaagctttgctgtttttatgtacatcctttcttcttcctgtaattcagcaacaaaataaaaaagcgatttcccaatcggaaaatcgccaattcagacactctattatttatgtgtgtctttgtgctcttaacgatttacaacaaatgttgttacgctttgagctggaagatgggcccaaaaatgattgcctgatacagtgagattcgttccaggttgtagattgctgctgctgctcgtgatccatctagatacgtttgaagcagatccattctgcaaaacaaagttttggttgactcctgtgttgcttttattgatggcaacaataacgaccttgttgtcacctttataggctgacacgtaaacgttcgcattagggtttttcgttgcatcaatccttacatagccgggacgcacaaactttgagaaatgagccatattgtagccgcgtttgctgatcgtaccatcttctttcataggtccatatgatcttcggatgtaccaccatacataagcttgaaagtccccctctaccatcgcattgtgaatatgctgtgaaacatccaatgcctcaggccatcgatccgccgagttgttatcactgtttggatagtatacttccgtcatccaaaggtccttccccgctcctttttgtttgaaaagaggataagggaattggctgacctgggtgccgtacaggtgagttccgagaatatccatattggcaagagcctgcggatcgttcaagatcgggtccgacaaattctttaagtattgaaaagactcaggtgcaatgacgcgggcattgatcgagccggcgttttctctcataaagcgaagtatttcttgcggcgtccaccacgtccactcgtgagcgtaatcaggctcgttttggaccgaaatcgcataaagattcacaccattatttttcatgaaggtaacaaaatcgttaagatgctgcgcgtatgcggcgtacttatcgtatttcagccgcttagctgatgtgtcaccattccgattgaaggtctcaaccatatcacttggaggattccagggagatgcaaaaacgattgccccatgtttgaccgcactcttggcagtctccacctctttataccaattatttcgattttcatctacatgaattcttaagattgaaaatcctaactggttctgtccattgccaaaagcagtttctctttgagctgctgtaagatccccagcccaagccggatggttcatccctccaaaaccgcgaatcacttgtttctctgcagatacattaactgttacatcactggctgccaaaacttcagtagcgcctggccctaacatgactgacagcatagtgaaacatactaatagtacacaaattgttttttttatgcgtggaatcatttattcctctccttcgtcatgtgtcttttacggtattaaaaaatctgtatggcatatccataatggcgggctgttccggtgatggctcgtacttcacccgcctcgtttttaagtggtcccattacgagtcctatctttgcgtaaactgccagtaatcaaaatgaaacaagtttcctgtacctgttccggtaaatacaaagaatactttgtgcacaccggttgccccgcttactgcagtttctatttctctccaggtttgcgctccgcctgttgaaggcacattcagagttccaacaagcttaccatcagcattgtcgaggcgcacttctattttcccgcctgaacctgaagtggatgctacatttgctttaaatgacctggcaccgcccgctccgaagtctgcatttcctacagcaatccagtctccattttgaatgcttgttacatgctgattatttactggcccgccgggtgctgtggacttctctgtcaaaatgcgtccattccaagcaaacgtttcagcttctacccggttataaggattcaaattggaaagctgtgttacacctgcataatttgctgctacctcttggatggatccatctgggttatgcaccagcttattaatatggggagaacggtatcctttgccggccccgaacagagcggaactgacagtttgcgcgtggtacactacataccactcgtttttaaaattgaaaacagcatgatgattgtttccgccacctccgaaaaatgcacccggatttttcaggaaatgccctctatatgtaaagggacccatgggatttgaactggtcatgtagccgatctcacccgggggtttatcggccgggtgcgtgccgccgaaattaatgcaataggagtaataatatgttccgttatacttgtgcaatcccgaatcttcaaacatgaaaggcgcatcaattgtagatgcacttccaacaacactcgtcatatcaggccccaattttatgactctagccgttttaggattggcccattgtccctgcgttggatttgaaccgccaggaacgcctcccccggcatacaggtaaccggtgccgtcatcatctacaaatactgccggatcaaaaagccatacaacaccagacattcctggcgtacttggcgttacgagcggttttccgattggatcggtccatggaccaatcgggctgtctgcggtgagaaccccgatacctccgccgctgtttgcgaaataaaggaagaatttatccttgccattgattttttttactgcgattgacggtgcccatgacgcccctgcccattttgctatcccacggtcaccattagctccattggcacctgctactggaatggctccgtggtctgtccagttcaccatatccgctgaagaaatgacgaatactttattcaaattggcaaatgaattatctttaatcgttccgttgctattatattcatagtcatcacttgacatataaatatagactctcccgttataggtcagcgcaatcggatctgcgcccaaatgatggtcgataagcgggtttgaattccctacatgttttgcaattgtactactggtggcagcatacgcagactttccagataaacagctcaatagtaaagcaaaaacaaataaacatacgctacacttttttctcatcacttaacagcctcctttttccttaaaatgaagggttcttttgaaatttgttaacaacaggtcatgaagactgcaccacttgtttcttcaagatcaatctagaaaagttcccccattcctagcggtcattgtccagaaaataaaatggcgaattgttcaagtcccctataacgcttgagcaggtatgtatatttattcaaaaaaatccctttatctaacatcctaccttattaaaaaaatagtgtatagaatacttttggaggaattcgtgttcgattctacaaaggaactggatacatttattcattgtttagatggggctacatatacggctgttaccgactcttcttcgcttagactgttccctcgattattgacataataaacatcatctctgctgatagggaatcaaggcttaaaaccactcaatctattgaagtattgttctcttctttgcaagacctttcgttatcatttcgccctcttcccctgcgaaatatgtcatattttttcatctttttgtaatgagcgttttcgaaaaatcagccgttcatgccgctgctttttaaagagtataaaaactattgagcggtatacccgcttttttcatgttttgttcatattttattaattgtttattcaacactgtccgctatagtaatccatatcaacaaatatgactgccactcgcatcttttatgaagggaggtccgttacgctgaaagaaaaaataaagaccttaggccgtttttgcaccgtaggcgtcggcaatacgctgatagattttggtgtcttctttcttcttaccgcttgtcatgtctcttatctgccggcgcagatctgctcctatactgcaggtatcgtcaacagctatgtgtggaaccggaattggacgttttgtgtgaaacgtaaggctgacgggaaagagatcgtgcgttttctcatgattaatattgccgcgtcggggatcacctttttgctgctttatttgtttcaaaattgcggctgctcgcttttggtgagtaagctcgccgccactatcggcggaatgatgatgaattttatcggaaaccgaatctgggtatttggagattcgctgaaaaacatacaggatcaggagtgaggatgaatgagaaaaaaagtgagaaaagcggttattcccgcagcgggtttaggaacgagatttctgccggcgacaaaggcgcagcctaaagaaatgctcccaatcgtcgacaaaccagcaatccaatatattgtagaagaggccgcagagtcaggaattgaagatatactgattattacagggagaaacaaacgctcgattgaagatcattttgatcggtcggtcgaattggaattcaatctccgggaaaaaggcaagacggagacacttaaggaaatgcagcagattgccgatttggccaacattcattacatccgccagaaagaaccgctcggattaggccatgcggtgctgtgtgcggagcattttatcggagatgagccttttgctgttctcttaggtgatgatattatggtgtctgaaacaccggctcttcggcaattaatggatgtatatgacgtttatggcacagaggttgtcggtgtacagtcagttctccctgaggatgtcagcaaatatggtattataaatacatcagggtctcaagggcatgtatatgaagtgaacgatttagtggaaaagccttctcctgaagaagcaccttcggaaatcgcagtaatgggacgttatgtgctgaattcttcgatcttctccgttttgaagacaattggcagaggcgcgggcaacgaaattcagctgacagatgcgcttcgtgaggtttgccgtaaggagccgatccatgcccggctgctggaaggaaatcgatatgacattggcgataagctaggctgttttaaagcgagcaccgaaatcggcttaatgcgtcccgaaatgagatctcagcttttggcctatttagaagatgtgatcaaacaggaaacgaaagaaatgctgcggtaaaaaaattgtaaccatcttgctcgtcaatcagtcatataatagtgaaaaagattaggacaggttgtgaagaatgtgggcagtttgataagcgaaattttaacatggctgacgaacatgggatatgcgggtattgcgattgggttaatgattgaaatcattccgagtgagattgtattagcttatggcggctatatggtatcggagggcacgattggatttattggcgcaattattgcgggtgttatcgggggcaccattgcccagatctttatttactggatcggccgctatggcggcaggccatttctggacaaatacgggaagtatttattgattaaaaagcatcatatcgacatgtcggaaaactggtttcagaaatacggcgccggagttgtcttctcggctcgttttataccggttgtcagacatgccatatccattccggcaggtattgccagaatgccttttctcaaatttgtggtactgactgtgcttgctatcattccatggtctattctgtttgtttatttaggcatacagctaggaagccagtgggatgatgttgagaatatagcaggcacttatacaacaccgattatgatattggctgttgtcgtgatagccctttattttgtgattaagaaacgtacagccatatttaaacgatagctagcagatatgcataggggtgactgacgctcccctatgcatatttttttacttccgatgttgatttgccagcttcagattctccgctaaaaatgcgacaaacacttcatcccgcacgagcgatgcggcataatttctcttaataaaccattctgcctcttcaaacgctgcgaatgtttcgtcttgggtttctccgttaatttgaatattccattcgttgtctaaagggaaaagaaaaaatctcatttgtgcgcgattttcatataatgatccattcgcagatccctttagattatagatgttacggaaggcatccggccgtacaggatcaatacggaaagcttcagctacaaacaactcgtatacttcatcggttattgaacagccggacgcttttgcatgccctccgccgccatatcggccggtgatttctgacacatcgatgtaatcatgaatggtgcggagactgactcgttttgaccccatgctcaaaatcgcaatgtaatcgaggtgcggattatctttccctagcctgttccccagctctgaatggtacgattcagcgtgaacgatgcctacacagtgttcgtgaacaaaggtttgtaccatttcccttttctttctgcggaggtagcgctcgattttttcgtcttctaaatcaagcagtttttcttcaaaatcatcgaagaaaaattcgtcatgcgcggaaaggcgctggatcatttttgcttcaaattcatcgattgacagcaaaaagaaaagatcattaagccgcttcgcctgtttttgatcgtaccgctcccactcccatgtatcgtattggcggacgagctctgtgaattgatctaaggcatttgtcggtttcatgaagccattttcaacgagatagccatataaaagcgatgtcgcggatgtgagccttccatcatcgtattccacctggacaaatccccattcatgctcattcaaatgaagggctgttttatgatggtcaatgagcttcactttgccccctgcatgaacatactcattcaatctctcttcgttttcttcattgactgcgagatcggtgatgaataacgcgtcctgtctgttgctctccttcgctttttctaaaaagtactgcacctgtgcgtttaagccattgacagagttatatcggacctctacgtcttttccgaacgctaattttgctacgattccgcaccctactccgtccaagtcgttatgtgaatataaatgatacataatgtaggcccctttttatgataaactgacaattgccgctagaggtgcggcagcctttatttactattctaaaaaacaaagcgttttatgcaaaggtaattagttgacataatgttgttattgtaaatatataaaggagcgctttttttgcgctcctaagttcttgcttttacactggataaaccggatgctttcgattggtaaatgtcatttcctttgtcatgtatgccttgagccgtttggccagctcatcacgcagcgaattggctgggataacagcatcaatgatcatttctgaagccagacggtagatattgatgtcctctttgtattcctcccgtttgctgctgataaatgcggctctctcttcttctggcagctcggcgatttttttagcgtagacagcgtttacagcggcctcagggcccatgacggcgatttgggcggttgggagcgctagacagcaatccggttcaaatgccggccctgccattgcatacaacccagccccgtaagcttttcggacaatgacagagagttttggaacagttgcctccgacatcgcagaaatcattttcgctccgtgtctgataatcccagcctgttctacttttgtgccaatcataaaaccggggatatcggctaagaacagcaatgggatatgaaaagcgtcacataaggtaataaacttagccgctttgtctgctgaatcgtggaataagacgcctccttttaccttcggctggtttgcaacaatgccgacaggctgtccgtggattcgtgcgaggcccgtcaataattccggtgcaaataaggctttgatctcaaaaaatgagtcttcatctatgacccgctcaatcagctcatgcatatcaaaaggtgcgttttgattttgcggaatgacgtcggcaagcggagtgtcgaagtgttttggcgggcgtttcttatgaatgggcgctttttcttgaaaatttgccggaaagtaagacaaataagcccgcgccagctgtatggcttcttcttcagtttctgcaagaatatctccgcagccggagattgagcaatgcatacgggcgccacccatttcttcaagagacactttttcgccaataaccatttccgccatccttggcgagcctaaatacatggaggcgttaccgtctaccataacgacgatatcacagaaggccggaatataagcgccacctgccgcagatggtccgaaaagcagacagatttgcggaatgcgtcccgataatttgacttgattgtaaaaaattcttcctgcaccgcgtctccctggaaagacattgatttggtcggtaattcgggcgcctgctgaatcgactaaataaatgagcggacagtttaatttttcggcggtttcttgaattctgatgattttttcaactgtttttgctccccatgaccccgctttcactgttgaatcattcgccatgacgcaaacagtttggccgccgattttgccgatagcggttacaactccatcagcgggaagcccgtctgacatacattccgcaaaaaaagcgtcttctagctcaatgtcatcgtcaaagagaagggaaagccgctctctgacaaagagcttgcctttttcccgattgctttgatgatacttttccgctccgccttttcgaatccgttcagcccgttctgttcgttccttttcataatccatgagcattgcctcccttttatattcccttgtatacggcccgtcttttttcttgaaaggcctgaagcccttctctcctgtcttttgtcgggatggtttgttcatacgctttttgttcaatcgcaaggcctgtagcgagatctgtctccaatcctttattgattgcaaatttagcctgacggacagcgatcggcccgttggcagaaatggctgcggccagttcctctgcttttggcataaggtcacaaggagcggtgacatgctctacaaggccgatttcttttgcttcgtgtgcggtcacgcgtctgcctgtataaatgaattcttttgcttttcctctgccaatcagccggggcagcctttgggtccctccagcgcccgggataatagctaaccctgtttccggaagtcccagcacagctgattcagttgcgattcgaaggtcgcatgccaatgccaattctagtccgccgcctaatgcgcttccatttatcgcagctatgaccggctgcggcaaggcatcaagtaaagccgccgttctttgaatgagagatacactttccagaacctgatcttctttcagttttatccgttcctttaggtctgcccctgcacaaaacgctttttcaccggtgcctgtgaggatgacgcaacggatgtttgagttaaattcaatttcctggataatcatttgcaggtttctaagcatttccgctgaaagagcatttgctgcctgaggcctgtttaaggtgatcaacgcaatatgttcatttttaacagtaaaaagaatagaatctcccattgtatgcgtcctcccttttatcaagatgatttaaacacctgtaaatttctgctcggcagcggtttgcccattttttcttcaatccatttggccgcagatagcagtttttctagctttacatttgttttgatatccatctgttcaagcatgtacacgatatcctcagttgcggcgtttcctgatgaacctggcgcatatgggcatcccccaagcccgcctgccgagccgtcgaacaccgtgatgcccatttggagtgctgtgaccatgttggccagagcggttcctctcgtatcatgaaaatgcaaggcaatttgattagccgggaatcgtgccaaaagagcttcaagtacagtttccacttgggcgggattagccgctccaatcgtatctccaagcgaaagttcagaaatcccaaattcaaatagagcttctgaaaggcgaatgacttgttcaatggggacatctttttcgtacggacagccgaaaacagtcgagaggtaggctcttgttgtgaggtttgctttttgtgcgtcgttgtttacttgtttgagtatatgaagggattcagaagtggatttattgatgttttttctgttgtgcgtctcgctggcggacataaaaacgcaagcctcgttaatgcctccttcaagtgcattctccagtcctctttgattcgggacaagtgccgcgtacgttaccccttttaaacggtcgatgccttttgctacgtcgatagcatctcgaagcgccggaatccatttcgggtgaacgaaggatgtgatttcaatatacgaaagccctgtccgggaaagctggttgatccaggttattttatcctctgttgcgatccatacgggctcgttttgtaagccgtcacgcgggccgacttctttgattgtcacttttttaggatatgacatgttcttcctccaaattattgagtggaatcgctcagttcgagcagtacgtctccttcatttacaaagtctccttcattttttttgacttcttttacgattccgcttctatctgcaacgatcgggatttccattttcatcgattccaaaatggctacctcctggcccttttcgatttggtcgccggctttgacgtggactttccacaggtttcctgccatttgtatgctaaccgtcatgacaactgcctcctttataggtgttgtttcaaaaagtcagtcgtgacatccccttctttaaatgcctttgttgccgcagcctgtatgagaagcggaagatttgttttgattccctctacacgatagtcgcgaagcgatgtctctagtttttcaattgcttctgttctggtttggcctttgacaatcatcttagcgatcatcgggtcataaaaaggggtaacggtgctgtcttttgctaccgcacattcgtgtctgactcctttttggtcaggaagtgaaaacgcagtgatcgtacctggtgacgggaagaaggtcttgggatcttccgcgtatattcgaacctctatcgcatgcccgttccgttggatgtctttttgggagaatgtgagtgtatggcccgcagcaatccgcagctgctgctcaactaagtccaggcctgttatttcttcagtcacggggtgttcaacttgcagtctcgtattcatttcgaggaaataaaaattttgcttctggtcaactatgaattcgatggtgcctgcgttcgtatagccgattgcctttgctgcttttaccgctgtttgcccaatcttcattcttagttcatcgtctacaaatggagacggtgcttcttcaatgactttttggtggcgcctctgaacagagcaatcacgttcaaacagatgtactgtatggccgtgttgatcggccaaaagctgaacctcgatgtgacgcgcatgttcaataactttttctatatacatcgacccgtcaccgaaaaaatctgctgcgcgctttttgtttccctcgtacgctttttttaatgcttcttcattttcaacacgctgcattccgatgccccctccgcccgctgaagctttcagcatgacaggatagccgatttgacatgcggtgcggcaggctgcctctatatctccgagggattcagaaacgcccggcaccacagggacacctgcagcctccattgcttttcgcgcttcaattttgctgcccatctttgcgatgatatcaggggaaggtccgataaacacgatgttttcttgcttgcagcgttcagcgaaccggctgttttctgataacaatccatatcccgggtggatcgcgtcggcatttgcttttttcgccgtctttatgattctctctatatttaaataactttcactgactctcgattctccgatcaaataagcctctgtagcggcttttgtatggagcgcgtccttgtctgcttctgaataaaccgcaaccgttttaatgccgagacggctgcatgttcggataattctcattgcaatttctccgcggttggcgatcagtacttttgtaaacatgatttcacctcattgacttgatgataggttgaacatttcaatcgttttttctcgcagtttatatttttgaattttgcctgaggccgtcatcggatagtcatccgtaaaaataacataacgcggaattttgtggcgggcgattttccctttgcaataggctttaagctcatcaggtgaaacgcttttaccgtctttcagtttaatccaggctgcagcttcctccccgaatttggcgtcaggcacaccaacgacctgtacatctaaaacagcgggatgccggtataaaaattcttcaatttcccgcggataaatgttctcgccgcctctgatgagcatatcttttaatcttccggtgatgcggcagtatccgtcttcatccatgacagcaagatctccggtaaacagccatccgtcatgattgattgcttttctggtcgcatctttgtctttataatagcctttcatgacgtgatagccacgggtgcacagttctccctgcatgcctctttgaacttcttgacatgtcccaggttctacaattttcacctcagtatgtggcagggcgcggccggttgtttcgactcttcttatgaaggaatcatttgctctcgtttgcgtaatgactggcgaggcttcggtttgtccataggcgatcgtaatgtctttcatgcccatcctttcaatcacagctttcatcacttcacttgggcagggagagccggccatgattcctgttcggagcgtcgatagatcatatgcatcaaaatccggatgatgcagctcggcgataaacatggtaggcacaccatggagcgctgtgcatttctctttttctaccgttttaaggacggtaacgggatcaaattcttgcacgggtatcatggctgccccgacggatacacatgccaaaaccccaaggacgcatccaaagcagtgaaaaaacggaaccgggatgcacatgcggtcttgagaggttaaagccatacattcagcgatattggcagcgttattgatgacattgaaatgggtcagcatcacgccttttggaaaccctgtcgttcctgatgtgtattgcatattaatcacattgtctttatccaggctgttcattctctcttcaagctcagcatctgtcactgttttcgccaatatctctgtatcgtcccaattatacatgccaggcaaccgtttattgccaatatagatcagcgtttttaaaaagggatagcgttcagatttcagttggccgggctttgcttcgtgcagttctggaattaaattgctcacgatgtctggataggaagtgcccctgtatgaatccatgatgataagtgccgcggcatccgattgctttaacaagtaatcaagctcgtgtgcttgataattggtattgacagttacgagcacggctccgatctttgcagttgcgaactggacgacaagccattcagggatattagaagcccatatggcgacgtggtctccttttccaatccccatccgcatgagacctttagcggtttgacggcaaagattgtcaaattgggcgtacgtatagcggatatttcggtctggataaacaaccgcttctcgatcgggatacgcatcagctgtttgttccagcagcctgccgattgtggaatggatgagttcagccattgattgttcctcctttcttaataattagaaagcgtttacattttcattttaaaagctgtctggcgatcacgaggcgctgaatttcagatgtgccttcaccaatttccattaattttgcatcccgcagcatccgttccaccccgtactctttcatatatcctgaacctccatggatttgaatggcttgattgcaagctctagtcgccatttcagatgcgaacagcttggcgtacgccgcttcttttgtgaacgggcggttatggtctttcagccaggcggcttttaacaccatttgccgtgctagatcaatttccatcgccatgtcagcaagcttaaattgaatcgcttggaaggaagaaatcggctgtccaaattgcttccgttctttcgcatatgccaatgatgcgtcaagggccgcttgagcaatgccgactgcaagagcagcaatggagattcgaccaccgtccagcgtatatagaaactgtttaaatccttttgttggatcgccgagtaagttgcccgcaggcactcttacatcctcaagcaaaatttctgctgtattcgaaccacggacgcccattttatcgtacgggctcgtaatcgtgagtcctggtgtgtcagttggcacaatcaatgcggagatgatgttttttccgtctttgtttttgcctgttaccgcggtcacaataactgtccgtgcgtagcttgcatttgtaatccagcacttttcgccgttgattacatactcgtcaccatttgaaatcgcttttgtttgagtgccccccgcatctgagccggcatttggttccgtcaggccgaatgatccgagtgctgtgcccgaagccagcggcgtcaaatgcgtccgtttttgttcttctgttccaaagtaatagagagggctggcgcctaatgagaccgctgcagcatagcttaatccagtactgccgcaggctttgccgacttcttcaaccgctaaggcatatgaaatcgtatcaccgccagatccgccgtattcttctggaaatggaatacccatcagaccgagttcacccatttttttaaatgtttgcatcgggaactcgcctgtttgatctacatgttcagcgtgaggagcaatttcttttttcgcaaaatcttttaccatttcacgcaccatttgttgttcttttgtcagctcaaaattcacatcgtttcctccttcacatctttgtaacatcctattaggcgagttctataatcattccctgacaagaaaagtctgaaaattaaaactgaatcattttttatgtgataatttcagcggaatgagcaaatacatgcagtaggcgcataccatccatatcgcaaacgcaataacttggccctttgataaagccgggaagatgaggggatgattccaaagggaaatcgtatccatcaataaaccgaccgctgatccccatatacctagcttgatcaccgcgaactgtgattgaaaattcagcggtttaccatcgtttcctgtccccaaaatcactttttaaaaaaagacgacttagaaagccgtccttctcatttcttattttgttgttcgtttggaagccttgctttcgttatgaagccggtctgctgaagtgacataatacgtatatttcttgttaggatctgccgtgttatctaagaaggtttgctgctcatgtgtttttctttgagttgccagcaatgtgttctgctttttcccttcggctctgtatatcgcataataggctgtttctttcgttttttgatttgatgggtgatctttaatctgcagaagattgccgtttttgtcttcggtgactttcgtaagcttcggttttttgggggcggtattgtcaagccaaggcatttgcggaaccagtgccggcttgctgtaaagatcggcgataagcctgtctttgatgccaagcggatttttgttgaggtccttgaggctgaaatgcatgcttcctttcaccagttcaagctggcggttcaaagtgatttgccgcacatattcctcagggtcggaccaaggcggatcaaaattgttattgattttatatgctgcctggccaatatataagtgaacaggcctatttttgacttcattgctccaccaatcagccagcacgtcgtaagccgctgcgttaaagccgatactccaataaatttgcggagcaatataatcgatgtcgccttcttggatccaatgtcttgtgtctgcatatagatcatcataatttctgacgcctgcttttgtattcgatccggtcgggtcatctgcggcgtttctccatactccaaagggactgatgccgaatttgacatacggtttttcagctttaattgtttggttgatttgtttgacaagctggttcacattgtcccgccgccagtcatcgatattagaaaaagcgtcttttccgtattgttcgtactgtgcttgatcaggaaattcctgtcccgctattttataagggtaaaaataatcatccatatgaatagcatcgatatcataatgttttacgacttcttcaatgcctttgacgataaaatctctcgtttctggaatgcctggatgataatacagctggtttccataggcggcaacccaatctggatgttttcttgccgggtgactctcagacaatttattaagatctgtatgattcattgtaatacggtaagggttaaaccacgcatgaaattccaaatttcgtttatgggtttcttcaatcataaatgcaagaggatcatagcccgggtccttcccttggacaccggttaagtattccgaccaaggcccgtaagctgacggataaaaggcatcagccgtcggtttaatctgaacgataacggcattcattcccattttttgcacatcgtccagcagtttgatatactcctgtttttgctctttcacagataacccttttttggacggccaatcaatatttaatacggaagcaatccatacggctctcagctccctgtcagactgcgcattggccataaacggaacggaaatgacaaacgttccgatgatcaagctgacaaggaaacggacaatcgacttttggcaaaccttcattctgtttcttctcccccattacatcactttcactattcgctattacggtattcccgggctataaaagggtgattaacagaatgtctatctcactaaataaacgaaaaaagtcctaaagcatgttgtgagccgcttttaggactttttatcatttatcatggtttgcagactttttaacacgtcaataagttttacgccgacaccgacagccgtttcaaggatcgcttgtgctccggcaatggctaaaataaagatcagcggtattgcaatacgaggcaaaaaaagatagccaagtccgatcaagatggcacaccaaacaccggcacaccagtagcaattgagcatgtatccaaagttagaagccggcacgcttttttcatctacatgcccgttttgatcaacaatccttttctttttcataaaaggttttcggataaattctgtgattttgtcgaatacaatcaaatgtgtcagcctgtaactggctagaatcagcatgataaacgtaagaaaagatagatgatccatgacaagcctccaagaaaaaggatgatgttatcattccctagtgtcatcgatccattctttgatacaaaaagaagcggacagagaatgcctctgtccgcgaatctgttctattgtttgtgcgggattgctttatttgaagtgatcttttctaaaatgtcaaggatgatgtcagcattcttttcagcatatgttccttccagcatgtctttatgagcgccaaaacccgtgtactcgctgtagtttccacaggcgccttcccatttcgttaagcctgtattctcgctggtttcgatttgaattccagcttcgatgaaatgaatgcttgctctgatgtgcccttcattcagcaattgtgcccaatattcttgatagtttctttttttcttcatcaccttttctctgactgcttcaggcagatatgctgcagattcgttattcccggtatcaataggcaaaggctgttcttttagataagcgtccacgataatgaagtcgctgacttctaatcctttgcgctccatagcctgtgccacttcaaaagccaggtttccgcctgcagagtagcctaataaaacgtatgggccctcaggctgtatgtccgtcatgcaattaacatattgttcaatgcgggtgtcttgttcaataaagtgaaacccgtatacggctgccttctcattcagtaataaagcaaggtctttgaaataaatgccaaatcccgatatcggcgggaagcagaaaagattttgcgcgccgtgctggttcagtttgatcacatgctgttcatctgccgctgtcagctgtttagaataaagtttttcggcaagctgagcgattgtcggatgttcgaacaagaaatcaatcggtatgtcaatgttctgctgatgtttgagtgtatgtatgacttgcagtgcttttagtgaatgtccgccaatagcaaagaagtcatcatcaatactgattgtgttaacaccgaggacttgcttccaaatgttcgccaattcttcttcaaccaagtttcttggcaatatgatgttctgtcgtttggcaggcttattttctggaataggcagcgcgctgcggtctatttttccgtttccggtaagcggcatccgctccacacgcacccagtgctgcgggatcatatagtctggaagcacacgcgccaaatcggcgcgaaaatccgtatctgtttttttatgatcaccgacgtaatgagtgtacagctgcgcctctccatctttttctctcaatgtcactgctgcttcttgaacgccttccatttctaacaggcgcgcttctatttcggcgggctcaattcgttttccgcgaattttcatctgcctgtcaattctgctgatgtattctaagtttccatcaggcagccagcgtgccaaatcaccggtacggtaaattctttctccaggcaagaaaggatgaggagaaaaaacagtatttgtcatgtcatctctgttcaaatagcctttagcgaccccatcaccgccaacacaaagctcgccgggaacgcctattggcaaaagacgtccttttgtatctaagatgtaagcggtgctattgctgattggttttccaatcggaatcggccccgcatagtctctctttatttcaaaaaaggttgaaaaagtcgtgttttccgtaggcccgtaaatattatgaagcgcgagatctgggcaggcgtgcctgacagcattcatcagagcaggcgaaagtgcttctcctccgacatataacgtatggagtccgcgaaacatgtcagctcgtacctgtgccagctgattaaaaagagctgtcgttaaaaatagcactgtgatgtcattttcaagcaaatacgctccaaaccgatcaggtgtcagcattgtcgatttatcaatgatatgaaggcttgcgccatgtaaaagtgacccgaacatttcaaaggtgacggcgtcaaagctgatagatccagtcataataaaccggtcatcaccggacgcagacgtgtaattgctgtttctgacaagggacacgacattgcgattcgtgatcatgacccctttcggccggcctgttgatcctgaggtatacatgatatatgcaagatcgtctggactggagatggtgttgataggaaaatggttctctcccatcaatgcctgcgcatctgcaatcatacatgttcctgagaacgcagcattttgctccagccccttttgaacaatcagcatttttgcttgcgtttcctcaagcataaagctgactcgttcaggcggaagctcctcatcaagcgggaggtatgctccccctgcttttaatacggcaagcacactgatcatgaattcgggagaatgtgcagccaatattccggctgtctcgtttttccgaaatcccttttgaattaactctctggcgagcgcattagagcgtttatcaagctctttatacgaaatagacatattgccatacacaagtgcggtatggtctggcgtcttttctgcttgttcgcgaaataaatcgataattgtatgattctttggatactccgttttagtattgttgaactgtgtgacaatctgctctttttctgttgcatcaagaaaagaaaaatcagcaattggcatatgagggtgctgtgcagctgtgctaagcgcttgcgtaaattgcctcttgatacagctgatccaggcagcatcgtaaacgaatgcattatagctgaacttgacgacaagctcttcgccgggagcaacgacaagattaaagttatatcctgattgctcggatacttgaacttgatcgatttgcagcggtgaatcggtttgatcagcggaatcggcgattttctgctgtaacggatagttttcaaagacgataatgtgatcaatcagttcctgttttaatgcggtgtttgcctgaatatcaaataaaggctggcaggtaaacggctcagcttccagcatttctttctggcagcgtatgagcagctcgtgaaacgtttcgtcttggtgtgttttaattcgaatcggtatggtattgataaacaaccctatcatttgctccacgcctgggatttctgacggtcttcctgatacaactgcgccaaacacaacgtcgtctgtgcggttatattgctgcagcatcacaccccagactgcctgaataagggtagcgagcgtgacgccgtgttgtttggcagtctctttcagcttgtctgtcagtggtttatttaatgaaaatatcaaatcttcacggtgataaccttcttttgtttctttatcagacacacgaggcagaggtgatggagcgctgtagttttttaaataggtatcccagtaggccgctgctttttctttgtctcggtttgtcagccatgaaatataggtgctgtacggacggacagggtctaatgaaagcggttttcctgcatgaatcgattgataaatttgcataaattcctgcataacgatacctaggcaccatccgtccattaaaatgtgatggtgactccagatacagacatgctcatctttagctgttttgaatagagaaatccgcatcagcatgtctttttgcagatcaaagcctttttgcttgtccttctctttaaagcgttcaatatactcattctggtcgtttgtcggcagatgagaaatgtcttcgctgttcaaatggaattcacgttctgtcatcacgacttgccgaggtcccgacaaatgcgggacgtgcggcaaaaacacggttctgaaaatatcatggcggtcgataatggcttgaatgctgcgctggaaccagtcatagctgaggcttcctttaatggtgaagagcgactgctcaacatacgccccctcctctttacggaggaaggaatgaaacagcatcccttcctgcatatgactcagaggataaatgttcttgatttttttaatggtattcatagtgtctgcacctttcttcacggattcattagtgaaaactgagcatatcagcgatctcttgcagggcgtcctcggtcagttcttgatcatcaaaatcactgatcgtcttttctgtttcgcttttgttctggcagtgttcgatcagctgtaataaaaattgacggcatgtttcgctaagctgttcgatggttttgcgctgaaagcgggcattgtcataagtcatattgacagtcaattttccttctgcagcgattgcgctgatatccagcgactgttcacggttccatgttgtgctgatatcacctccggcacccagcggagagaatgagaaggcgtcctcctcaggtacttcagctgtgcggccgctttcaaattgaccaagataattaaagctgatttctggtgcacctgtgaaattgatgtcttttttgccaggcggagtcaaatatttgatgacaccgtagccgaatcctttgtcaggtacacgtctcagtgtatcttttgttgtttttagcacatgaaccatgctttcttccgaatctggcaagtctgcgttcagtttaatcaataacggataaatggcggtaaaccatccaatcgtccggctcacatctattccttttaatacatcctctcgcccgtggccctctaatgatagtttgaaggcggattgattggtccaatggcgcagcgcaagaatgacagaagcgagcagcatgtcctgcgtatcagtgttatatgcgctgttggcatcttttaagagtgctgctgtctctttctcgtttaaggtaaacgaaatcgtggaccgttgtccctcgtgtgctctagttccatcaatgtgatcaaaaggcaatgcctctgtttgatactcttcggcctcgcgccaatacttgagctgtttcatgagctgctggctttcagcgtagtcagagagctttttcgtgtacgctttaaatgagcttgttttaggaggcagctgaatctctttcccgccgcctgcagcttggcgataccctaaagccaaatcttcaagcagaacccgccatgagatgccgtcaacgacgaggtgatgagccgataaaaataagaaatcaccgtcaattgtgtggaaaagaccggcttgcagcagcggaccattcttcaaatccattttctgctgaatatcaagtacatggcgtttgataataggctcatacgctctatttccatcagtgccgtccggagctgacaaatcaatcatctgaaggccgtacaacgcgtcgtccgaatgactgagcggccgattatattgatcccactttccttgttcattctgtgtaaacaccattcgcagcgcatcatgatgacacgttattgcttttaacgtttttcgcagtgcgtcttcttgtacagaggtgcttcgatgcagcattacggactgattaaaatggtgtttttcttttatatcttgagaaagaaaccatttttgaacaggcgaccattgtacgtctccctcaaccgcagcttggctggaacttgtatctgaatcacggatataagctgccaattcttgaatggtcggatggctaaacaaatctttcactgccatttgcttgcctatccggtgaagccgcgcagatacctgtaacgctttgattgaatctccgccaagttcaaagaacgaatcagctgttccgatcttttctgcccccagtacttctttccatatatctgccagtatttgttccattttgctggatggcgggaggaatggacgttcaccttcgtggttgtatacaggttttggaagtgctccgcgatccagcttgccgtttggtgacaatggaagtgagtccagtttttcaataaacgcagggtgcataaacaccggcagcttgttttgtaattctgagcgtacagcatttgtgctcaaccctggttttgtcaccacataagcgcttaattcggtttgtcctgacgctgttacatgagcaactactgcggcgtcttttacaccctttatacaccggatgaccgattcaatttctttcgtttctacacggtatcctctgattttgacttgatcatcgattcttccgagatattcgagtgtaccgtcggccatccatctggcggcgtctcctgttcggtacattcgtgcttcgggtttaaatggattctgcgtgaatgctctctctgtcagttctggaagattaacgtaccctcttgcaagccctgttcctgctatacaaagctctcccgcaacaccgattggctgaagctgatgattgctatttaaaatcagcacttgagttccgtcaatcggctggccgatgcttacgtatgcctgcttttccatatgtctcatgacggtagtcgccacgctgttttctgtcggtccatattcgttggcgagttcggtatgcggacatatagctaagctgcgggcgatcaattcgcggtcagccgcttctcccgccagtgtgacgactctaagcgtctttacatcttccggctgcactacgtccaaaagcgctcgatataaaacaggcacaataatcatatgtgtaatccgttgacgagacagctgatgcttaatggccagaatatccttcgcttcctcttcatgaagcaaaacggcttttgcacctgacaaaagcggtgtaaacatactagttataaagccgtcaaatgagaaagaaaagagctgcagaatggtatctgtctcgttgaatgcataagcgtttcgccgccactgaagagtgttagcaatccctttatgctcgaccattaccccttttggacggcccgtcgttcctgaagtataaatgatataagccaaatgatgggcagacgacatttgcggcagcggcgatttgtcgtcttcctctacgctttctatcgtcaagatctctccttcaaagtcagcaagtactcccagatccgcttcatttattgtcatcagcagtttcgttccgctgtcgctgaggatatagcgtttccgttctttcgggtattcaggatcaatgggaacgtaacagcctccggctttccacacaccaagtatggatgctatcatactgaacgaacgatgcatcatgatgcctactggtgtgtccggcttaacacctcggctgcgcaatgcacgtgcgattccattggaccactcgtcaagctcctgataagtgagtgttttgtctccgctgacaagtgcagaagcttttggtgttcgtgcagcttgctgctcaaacaattgactgattgtttgaactccgtattgattcgcttgcccggtgttaaactcattaagcagctggtgccgctcttcttgggtcaggatgtcgatatggttgagtgtcaccttcgggtttttgccgatgatgctaagtacatttgttaaatgcgatgcccagcgttcaatggtggttttctcgaacaatgcggttgaatattcaaaaaggaaatgaatgtttccgtcgccctcagatgcctgtagtgtcaaatcgaatttagaaacgagatgagaaacttgtgccggcttcatttgcaaatcatgaagatgcaatggctcgtaatcattattttgaacaactaacatcgcatcaaacactgggttccggctcatatctcgtgtcaattcaagcttatcgacaagctcttcgaacgggtaattctggtgctcaaaggcttccaatgctgtctcacgcacttcctgcaaatactgtacgaatggcttcccgccctccgggcgcgtccgaagcgccagcgtgttcacaaacatgccgagtatcggctcaagatccttgtgcggccggccggcgattggcgagccgacgatgatatcttcctgtccgcttaagcgtgacaagaacgcggtgtaagccgcaaggagcaccatgtacagtgtgcttccgttttctcgtgccagcttgtgaaggcctgatgcaacctctggttccagcgtaaatgagaccttgtcacccgcgaagcttcgcaccggcgggcgggcatgatcagcggggagatccagcacaggcagctcgccctcgagctgcttcagccagtacgcctcctgcattttgtacgcgtctcctgttttgaatccttcttgccatacggcataatctttatattgaatgcgcagcgccggaagcttccgattattgtacagctcgccgaattcttgaatcagaatgttgacggaaacaccgtctgaaatgatgtgatgcatatcaaccagcaataggtgccgctcatctgatacctttacgatttgggcacggaacagcggcgcttggctgagatcaaacggtttgataaatgcggctgcggcctcctgttcggttcgttcgccgagaactgtagtctgtaacgtaaacggcacctcgtcatggatgcgctgcaccggatcgcctcctgcgtcctgttcgaaggaggtccgaagcgactcgtggcgcttgatcagctctttgaaagctctctccatcctttcagggttgagcttcccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacctcttttagcggcacctgtacatcgaattctttggagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgctgtgtaggtctccgcatctgccgctccgccaggagctggcagggcgtttcggtcgagttttccgcttggcgtaaccggccactgttccatctctatcatataggctgggaccatgtagcccggcaacagtctctcaagctgcgctcggacttcgtttctttggagcccttctacataagcgcataattccggctccccgctgtctgtccgtacggtaacggccgcctctcttacaccttctatacttcttagtgccgcttcaatttctcccggctcaatccggtagccgcggattttcacctgatcatccgtgcgcccgaggaattcaacattcccgtcagggagccagcgcgccacatccccggttttgtacatgcgttcacccgggtaaaacgggtcttcaagaaaacgctcctccgttaatgccggccgattcaaataacctctggcaacacccgctccggctatgtacagttcgccgatacatccaacaggcagcatccgctgattctgattcaggagatataatctgacatgatgaacaggttttccaattgggatccgttcaagtttttcatgcggcggacaatcaaagaatgcagcttctacggttgcttccgttggcccataggaattggttattgaaacatttggaagcaactcgtaaaatcgggagacaagatgggtccccagctgttctcccccagaaaacactcgcttgagtctgtttgtcttaatcggtacagagcgatattttatatgttctaaaaatgcatggagcattgaaggcacaaaatgcatagctgtgatcttttgttcttctatggccttcgcgatcacttcaggttctttttcgcctccctgaggaagcagataaacagaagctccggcataaggccaccaaaacagctcccatattgaagcatcgaatgaatatgatgttttgtgcataatcatatctgaatgctttagctgatagcgggactgtagggaattcaaaaaattcaccgctgatcgatgttcaatttcaacacccttaggcatcccggtagagccggatgtatagatgacataggctaaagattgcgggagaacatccacattcggattggacaaacgatgtgccagtccgctatttgtctgattgagatagacaatctctcctgtaaattccggaacatgaaggccggcagactgaagcaggagaatgtttgtaccgctgtcctccagcagaaagctgattcgttcttccggataatccgggtcgatgggcagataagcgccgccagctttaagaatgccataaatgccaagcagcatttcaggtgaacgctttcctataatggcaacagtcgtttcgggttttaccccccgtccgatcagctcccaggcgatacggttagcctgttcgttcaattctttataggtcatcactccatcttcgaagataacggccgcctgatcaggcgttttttctgcctgctgttcgagtgcatagtggagcgtttgattcattgaatagcccgtctcctcaaacagatggcatgattcaatgaaatctcgctcttcttcttttgttaagattggaatattgtccaattctgtttcaggactggcagctgtatgttccacaagcgtggtgaaaaggctggcccacctttggatggtttctttctcaaacaaagctgtactgtattcaaactgacagaaaagctcggaatcatgctctgtaacgtatagggaaatatcaaattttgatattgggtgctccaagtcgttccactgaagctgtacatcattcatttttagcttttgctgttccatattctgaaggactagcgttgtgtcaaacaaaggattccggctcatttcccgctgcacaccgagtttgtccacaagctcttcaaacgggtaatcctgatgctcatacgcttctagtgccgtctgtctgacttctttcagaaattcctcaaatgtcttattacccgccgggcgtgtgcggagagccaatgtattgacgaacatcccaagaacagcttcaaggtcggcatggggccgtccggcgataggtgaaccaatcacgatatcatcctgaccgcttaaccgagacaaaaaggctgaatacaaagcgagaagcgtcatataaagcgtgcttctgtttttatgggcgagccgctttatgcgggccgtgatctctttgtccaattgaaaggttactttcccgcctatgaattgccgttctgccggacgtcgtttatctgttggaagctccagtataggaaggtccccgctaaactgctgctgccagtaagtctcctgcttttggtacgagtctccctttttaaatttctgttgccatacggcgtaatctttatattggatccgcaatggcttaagctgccggtttgcataaagatcggtaaattctcggattaggagctgaacggatacgccatctgaaatgatatggtgcatatccaccagcaatacatgcttctcgtttgacacttctataaggcctgctctaaataatggcgcctggctgagatcaaagggacggacaaatccctcgatagtggtctctttacttaacgtaaacggcacttcggtgtggatacgctgaaccggctcgtcatcagctccggatacaaaggaagttcgaagcggctcatgccgattgatcagttctttacatacagcagacagtttggcgacatccagtgcaccttccagttctaagaccgcaggcatgttataggcgacaccctcatcaagctgttgaagcacatacattcgtttttgggccgaagatacaggatatgtatccctttcttctgctggttcaattgctgcatacggattttgttctgcctctcgaatgattgaagctaatccttcaacagtcggatgggcaaagatgtcctttagcggaacttgcacatgaaactccttagcgatccgtgacataagcactgttgcttttaacgagtggccgccatggtcaaaaaagttgtcttggatgcctatatggccattattcagtacatcttcaaatagttgtgaaagctttgcctctaacagatttcgaggggcggtatatgggtttccgctgattgaagcatctggctccggaagtgctgcgcgatctacttttccgtttggggtaagaggtatgctgtcaacccatatccatttcgccggaatcatgtattctgggagctcactagccatataactgcgtaaatctattgcgttcagcttttgtacactgcaatagtaagcgcataattcatgttcaccgttttgatcttgccagatgagaatggcagcctcactaatgtccggatgattcattagcgtgacttcgatttcttgcggctcaattcgataacctctgattttcacttgattgtctgcccgtccgatatattcgatgttgccgtcttcaagccgtctggccaaatcacctgtccggtacatgatcacatcaggcttgaatggatcggatgaaaatttgtcgcttgtcagtttatcgtgattgacatatcctctggcaacacttgcgccggaaatatagagttcgcctggtacgccgcatggctgaagctgtttttgatgattcaaaatatatagatcagtacagcctatcggtttaccgattggcggaagctcaggaatagggtctccaggatgaatggtatacgtagataccacatgagtttctgaaggtccgtaatgattgtgcaggtgtatgccgcgtttacgcaacacatcttggaaaaggtctgaaatcattaattgttccccggctgcgatcaggtgtttgacgccatcaggaaacgagttcgcaagttctcgctcgctgaaaatcattttgataaaagcagttgggagaaacacaatattcgtctgatgcttgtttataaatgcaaacagctgaggcacatctctttttatggcttctggcacgatgtgcagtgtgccgcctttcagaagcgcagaaaaaatttcttgatagcagacgtcgaaggaaggcgtcgcaaattgcagaacatctgcttcaaagtcaatgccggagtgagtatattcgaatttcagcaagttagccatgtttcgatgctcaaattgaacaccctttggtttacctgttgtgcctgatgtataaatcatatacagcagatcgtcagcattgttgactgactttatgttactgccgtctactttgctttcgatatcttctggatgagtgataatgtaattgtcttctaacgatgaggaaagatgcgcttgtgaaacaacatgcgaacagccgcaatcatgcagaatataacggattctgtcagccgggtaatgcggatcaaccggaacaatggcgccgcctgcctttaagataccaagaacacctgtgataaacgccgctgagcgttccatcataatcgcaacgggttcctgtctcacaacgcctttcattcgtaaatgccgtgccaatctgttagccgctttattcagttctctgtatgttaatgagcaggcttgatcaattacagcataagcatctggtgtcttttccgcttgcttttcaaacatggcatggatggtttcgtaaactggtgtttgatctgtgatttctccaatcagctgccgcttttcagtatctgtcgtgatatcgatttcttcaggtggaagattcggattatttaagatttgtgatacagcattcagaagatgctctttgacagagagcacaaaagaccgatcgtgctgctccgcatcatagttcattttgatatgaatttcttcccctggcgccaccataagataaaagctgtagttggtttcatctgcgacagtgaaattatgaatctgaaaaagatcagaagcatgttcctgtttgttcagcatttgaatctcttgctgcaccggatagttttcaaatacgagaatatgatcaatcagcccttgtttaacagctgagcgggattgaatctcatataaagggtggtagctgtacgcttcagcggcaagacggtctttttgcatatcttttataagttgaagaaatggcgtttttgccccctgcacccgaaccggcatcgtattaatgaaaagacctaccatatgttcaatgccttcgatttctgcgggtcttcctgaaatgacagaaccgaatacggcgtcatcgttattattatatttttgtagcagaatgccccaaatggtatgaaaaatcgtactgagtgtcacttcttctcttgcagcaagctctgaaagtctgctgctttcttccttagagaatgaaaatgtaacgtgttcctgcctgcttcttccctttgtttttttcttctgcttcgggagcacggtttgctgttcgtggccggaaagataatggtcccaataagaaaccgcctgctctttgtcttgctccatcagccatttgatatactttccgtatggctggaccggctctaatgttataggggatgcatttacataagatgcgtaaatatgcagaaactcctttagcacaatgctgaggcaccaaccgtccatcatgatatgatgaaaggtccaaatgcaagagtactggctctctcctgtttgaataagagcgatgcgcatgagcacatccttttgcaaatgaaacccccggtcccggtccttttctttccattgctcgataaactgtgattgctccgcctcgtttaaatgagtaatgtcttcttccaggacgatgatatttcgttctctcagaacaacctgctggggggaggaaacattttggctgataaaaatcgttctgaaaatatcatgtctttctacaagagcgttgatgctgttttgaaaaaactgcgggttgacttttccttctattgtaaaagaagcttgctcaacatacgcctgtgaatctttttgcaggagggaatggaaaagcatcccttcctgcatgtaagacagcggataaatatcctgaattgaattcgcttttgtcatgttcatgtctccctgtcacgattttctacaattcttccaccaagctggatatgctgtccaagtcctctgccgttaatgattgactgctgaaatcgctcagtgtcttttctgctttctgttgaccggcgcagtgtttcataatgtccagcaaaaagtgttcaatcctgttaataagctgctccattgtgtttttgtgaaagcgggctgacggataactaagattgaaatggagctttttgtctgctgccattgcgctcatctcgatgatttgctcacgcttccatgtatgagtgatatcctttccgctaccaaggcttgatgggcggaaggtgtcctgtctttcgatgtcgttgaactggcccaaatagttaaagctgatttcaggtgtttttgaaaacgtaatgcttttattttcagggtgtgtaaggtatttcagcataccgtaacctacccctttgtttggtatccggcccagtgtatctttaacggtttttactgcggttccgagctcatctctatgattttcaaagcttatgagggccgggtacatggatgtaaaccagccgaccgtcctgctgatatctaactctggcagaatgtgttctctcccgtgtccttccatagcgatacggagcttgcttccgcctgtccattcacaaatcgccaaggatgctgcggttaacagaatatcttgtgtatctgtgccataggcgtaattgacgttttgtagcaagacggcggtgtctgcttcagtcagtgaaaagcttaatgagtcccttttgctgaagtcgatgttcacatgatgcggtatttcatatggcagttctgcggcttgctgttcttctacacttcgccaatacgcctcttcgcgaatcagcttactgctttgggcatattcctgtatgcgtcttgcgtattcctggtaggaatccgttttaggcggaagctggatcgtctggcctgaagcagcttgttgatatccggctgacaaatcctccagcaaaatccgccatgagacaccatcaacgacaaggtgatgggtcgcaaggaacaagtaatctccggtcagtgttttaaacaaagcggcgtgcaacaacggtccttcctgcaaattgatgctttgctgaagatctgcaacttcttgtttgatttgcgtctcccagccgctttctgactgtgaaagatcagaggttcttaagctgtatagctgtgactcatgaatgccttggttgatttgaatccatcgcctgccatcgttgcgataaaccatccgaagcgcatcatgatgttccgccagttttttcaaggctggtctaagggcgttttcagacaaacgtccagaatggaatagcatgacagactgattgaaatggtgtctttcttcaatatcctgtgaaaaaaaccattgctgaacaggcgtccaaggaacgtcaccctgaacgggtccttgctctatgattctctctgacttacggataaatggtgataagtcctttatctttggatgacggaataaatcacttacctgcaagcttagtccatagcgcccaaggcgtgcagaaacttgaagggctttgattgaatctccacccaattcaaaaaacgaatcctctattccgatcctctggatgccgagaacttcctgccagatcaacacaagttggtcttcaaggtcatttcgaggtggagcgtacgtttgtttagatgtgaaatttggttcaggaagtgcttttcggttcaatttgccgtttgatgtgagcgggagagtctccatttcaataatgtacgccgggatcatatagtttggcagcgaacgcgcgagaagtgaacgtacttgttcagcattcgtgcctgcttttacgctgatatagccaaacagctctttgctcccggtctgggctgtacgtgctaacactgcggcttctttgaccccgtctatttgacgaagtgctgattcgatttcacccagctccacccgatagcctctgatttttacttgatcatcaatacgcccaacgtattcaattgtgccatcaggaagccagcgcgccagatcacctgtgcgatacagtcgatcgccaggtgcaaatggatgtgggacaaatttctctttcgttagatcaggacggcccaaatatcctctggcgacgccatctccgccgacacaaagttcaccgacagctccgaccggctgcagcactccccattgatttaagatataagcggtggaattaccaaccggccgcccgatcggaatggaaagttcatatgttttttgaatgtgaaggcatgtcgaaaaagttgtattttcggtagggccatatccattccatatagatacttcagggcagacatttctgattcgattgacgtggctcggcgacaaagcttctccgccaataatcaaatgtttcagctgtgaaaatgtttgttcattttgctctgtcaaatgattgaatagagaagatgtcagccaaatcgttgtgattccttgatgttctatgtacctcttaagctgatgggaatcgagaaatgtttgttgatcagacagatgcaaagcggcgccatttagcagcggtccgaaaatttcaaatgacccaacgtcgaaaccgattgatgatgtcataagaaggcggtcttcaggtgtaaatgtaatataattgctgttttttacaagacgaattacacttcgctgctcaatcatgacaccctttggtttaccggttgaaccagaggtataaatgatatatgcaagtgaatgtggccctgctgaagaatcaacgttcttcgtttctccttgcttttgaataccttcgattatgatttgttcacattcaatgtctaatagctgtttctctgttttttcagattgaaggagtaatgccgccccgctgtctgacagcatataagctattcgttcaacaggcagatcagaagcaataggcagataggctcccccggcttttagaatgcccagcattcctgcaatgagttctggtgttctgcctgtcaacaaggctacaacactatcaggccctacgcccttaatctgtagaactgaggcaatttgatttgcccagctgttcaggttctcgtaagtaaatacttgggtgtcgctgacaattgctacagcattaggcgtttgttcagcctgcatttcaaagagtctgctgatggtttcatttcttggataatctatttttgtacgattgagctcgtggataaggtaatgggtctcatcctcattcaggatatttattgttccgagagcggctttgttgtctttgatgatggagagtaacatattgatgaagtattgaagccacttttctatcgtttttttcttatataagtcagtactaaactccatttggaacgtcagcaaaccgcggggctgttcctgggcatatagggttaaatcaaatttggacgtttgatgcccattgtttgctgcaggtttgagacaaagttcatccagttccaacgattcctgatccatgttttgaagaacaaacattacgtcaaacagcggatttctgctcatatcccgtgtcaattcaagcttatcaacaagctcttcgaacgggtaatcttggtgttcaaaggcttccaatgctgtctcacgcacttcctgcaaatactgtacgaatggcttcccgccctccgggcgcgtccgaagcgccagtgtgttcacaaacatgccgagtatcggctcaagatccttgtgcggccggccggcaattggcgagccgacgatgatatcttcctgtccgcttaagcgtgacaagaacgcggtgtaagccgcaagaagcaccatgtacagtgtgcttccgttttctcgtgccagcttgtgaaggcctgatgcaacctcttgatccagcgtaaatgagaccttgtcacccgcgaagcttcgcaccggcgggcgggcatgatcagccggaagatccagcacaggcagctcgccctcgagctgcttcagccagtacgcctcttgcgttttgtacgcgtctcctgttttgaatccttcttgccatacggcataatctttatattgaatgcattttatatctgtgccgatttgctttcgttagtatccattttactaatatttttgaatcccaatacaatcaccagcatgatcaacatgagagtcataaataatcaaaatgcaggttgtacgggagactcatccagactccatccgactgcgattggcaggatagagccgccaatccattggcagcgagcagcatgcctgtcgtttgttcggaaaccggctcgggttgccaaatgagagaaaagatattactgtcattaaaacgattcttggtttcatccggatatgataaaatgtctcagactatatttaagccatttttttcttcagcattcatcttgcgtaattgataaaaatttattatgatactctttgtatgacaactccttgcctcaatacaatatactcaacgtttccccgttttccccggtcgtttttcttttcattttctcccgtaaaataaaaaaagctcccaatacaatagatatggtgcggattaattttttactaaaaaggagtcgttatatttgaataatagttttacattaaaacagcaatggttcggcaatatccgaaaagacattcttgctggcattttagttgcgttagcattaattcctgaagcgattggcttttctattatagccggtgtggatccgatggtcggtctttatgcgtcattttgtatagccattattatttctatttttggcggcagacctggcatgatttcagctgcgacaggctcaatggcagtcgttatggtgtcgctggttgctgatcatgggcttcagtatttatttgcggctacgattttgacaggtattattcaggtgattttaggtatcagtaaaattgcaagattaatgaaattcatcccgcgttctgtgatgatcgggtttgtgaatgcgctggcgatccttatcttctctgcgcagcttccccagtttgaaggtgcttcttggagcatgtatgcgatgcttgccgggtcgttggttattatttatgtgctgccgagatttacgactgttgttccgtctccgcttgttgctattattgtgatgacaattatttcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcacagattattgatgaaatgacggatacggacagtgataaaaataaagagagccgcggacagggaattgcgaatatcgtgactggattctttggcggaatggcaggctgcgctatgatcggacaatctgtcattaatacaaaagcgggcggtcgcggacgtttgtcagcatttgttgccggtgcttttctgatgtttttaattgcggtgttaagtcatgtcgtggtgaaaatcccaatggcggcgttagtagctgtaatggttatggtgtctgtcggcacttttgattggtcttccttaaaaggtctcaaaaaagcgccgctcacggactcgattgtcatggttgtgactgtggttacggttgttgtgacggatgacttatctaagggtgtatttgtcggtgttcttttaagtgccgtgttctttgtggcaaaaatctcgaagctgaaaatcgtttctcatgcagaggatcaaaagcttagaacgtatcaagtgaaggggcaaatcttttttgcgtcagtgacggatcttgcaaatgcgtttatttatcaagaggatattgagcgggtcgtgattgacttaactgaagctcacgtatgggacgattctggagcggccgcacttgataagattgttgcgaagtttaaggaacaaggcattgaagctgagttaaaaggtttgaataaagcgagtaaatctctaatgaaacagatggcataaaatagagaagcccagatgaatgagatctgggcttttttatataacatacacttaagcagcattgatataatagagagaagagaaattttaaataggggacttgcatatgatgcttcagaagctgaaccgtgtattggggagagtgatgccgctgttaacgccgactagtgtggtgctgggcgtgctgctgtctcagtttttaaatgggtatgaatgggctgtgccttggatctttgcttttattacgtttgcaggcagtctgagcgcgaactttcaatctttgagacatgcattgtctcatcctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttagttgatactgtgctgtcaccgctaatcgtaccgctgagtctttcattgctggccggcgctcaggttcacatggatgtgtggggaatgatgaaaggtctgattgtaatggtcgtgattccttcttttttgggcatgctgtttaatcagatgtcatctccagaaagaactgcgtctgtgagcagtgcgctgtcgcctttttcaaagctttgcttgatggcagtgattgcgattaacagttcagcgattgctccttatttcaaatccattgatttgagatttgcaggaatagctgtaacggtattctttatcgcgttaacaggttatgccgctgcttggctgatcggaaaaatgatgaaaaggcggcaagaggaaatagtctctcttatatttacgggaggcatgaggaatattagtgccggcgcagttcttgccgttacgttcttcccgactcaggttgccgttcctgttgtgattggcatgctgtttcagcagatattggctgctttgtttggctatatgctgaatcgttttgaattaaaaccaatgttgcagaaagcataaaaaaccgctcatagggttgagcggttttttccgtatagccattcgagcgcgttgatgaactgtttgcagaaatacttgcggtggtgcaccgctcctttttcaattgaaagatacaaccggtcttcagtgaagcctttttcttttagactttgatgaacttgctttgtttttttcagcatatgtcgctgaatggattgtttttcacggccttcttcattcccgacagacatgaaaacacgtacagtgcctggctttaaagaagatatatgaatggtttccgctgcgttctcgtaccagtatgaacctgatatagagccgattttcccgaacattgacggatattttaataaggcgaacattgagatgagtccgcctaatgaggcaccgatcattcctcttgactgcggttccctggtgacgttccagttttcttcgattagcggaatgaactggttcgttatataagacagatagtgatatcccattccgccgaagtccgtgaaccgatcactgagtgatgcagccggccaaggtgtgtattcatttagccggttttcgggttcgataccgatcagcacgagttcaggcagtcttcgctgttgaaatgcgttttctaataattcgatttggttttggaacaaagaactgccatcttgcacataaacagcaggaaatctcctgctgtctgtgctgtaggaaggaggaaggtacagcgtgaacctcctgttgccggctttgtgttctgaaagagatcctttcaagcattctccccctttttttgcttgaaaagcagatataagaaataaggaactccgaggatcgccaaaatgatgcctgcaggcacttctgcgggctgaaaaaacagttttccggcaaagtctgcgcttatcacaagaagcatcccgattaaaccgctcagtggcaggatatagcgatgttcgacgccagccagtctccgtgagatatggggagcaattaagccgacaaacgccatgcttcccgctacggagacacaggcgctgatgattgctacacaggctacgagcaggatggttttttctttatttgatgaaatgccgaggcttctgactgtgtcttcatcaaaacgaatggtgtcgagcaggcgggatttgccgataagaatcggtataaacagcagcatccatgggagtacggctgtgatatacgtccagttagcagaccagatgcttccgtttttccacaccatggccatttgatagtcttgcgggtccatttttaaagataaaaacaaagacagggcgctgaatcctgaattgattgcaatccctaccagaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcctgcccctgcgttgattccgagaattccaggatcagcaagcccgtttctcgtgatggcctggataacagcgcctgcaatgccaagaccgagtccaataatagcagccatgacaacccgcggcagtcttaaatcgaacagcaaaatttcatattgcggattcgggtcgatttgaaaaagagtggagagcagctcagcaggacaaacagaaaatgatccgctcgttaagctgaaataactgacaactagaatcaaagcgatgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggagcacggaatcagcctgctgtaatcagagccgacgagaaatctcgtgatatgcggaacaaccaacccgacaaacgcaatttttccggccagcgctacggcactgccggttagaatgatgacggaaagcatcgccatgattttaatggtttttttcttttgccccaggcttttagaaatgtcgtcccctaatgatacagcggttacctttttgctgagagaaatggccattataatgccaatcaggaaaaacggagcggcaagcttcaggaaatccggattcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacaccgctcctaacgctgagccgataaaagagtatatcatcatttcaatcgaagatgattgcgggagcagaaccatgcaaagcgtaatgataaacgctgaaccatctgaaacacccataatggatggcgaagctaaataattgcgcgtgatgccctgcataagcgctccagaaacagcaagggctgcccctatgagcagagcgccggcagcccttggaatccgggagtgccatataatttgatggtctgtgtttcccggatcgaaatgaataagagatgtaaaaacaatatctgtgctaagatgctttgccccataaaggattgaaagcaaaagcgacagcgctatagcaaatggagaagtaatcaatatgatacgtgtccactgttttgaatacatacataaacctactctgaattagttttgtgtcaatttttcagcagccgctttcaggaaacggactttgctccaagctgtgccgccttgtgcgagagggtccactgagttgacatacacatggtcttctttgactgctttaaggcttttccagattggatttttctctaaatcttttaaggcatcaggtttgtctgcattttcatcatcagaaaattggacgaaaatatggtccgggttcatttcacttaatttttctaatgaaatcagctcttgcgcttttgcagcttttacttcgttcggcgccttaaggcctaaatcaccgtatagtgtggagttgaaatacacctgttcagggtaaatgtaaatgttgccttgtctgattctgatgacaagcgcttttgaatctttcgctttatcgttgatttttgtttttgtttcttttagatcctgttcatagtctgcaataattttctttgcttttttctcttttccagtcagctgggcaagcagcatcatgttttccttccagtttgaagagatatgagaaactgggatcgttgtgcctgctgtgctgattttttgcagcgttttttccggaaactttgttgaagcaaggataacatctggcttcatttcaagaatcttttcaatatttggctccattttttctccggttggttcggctttatcagtaatgtctttgaacatatcagggaatttgccggagaatgaaattgcgccttgcggatgaacgtcaagcaatttcgcgtcttccattgattcaacgcttcccgtaatggcgattttgtctgtcggtacagttacttcatatgttttatcaaggtattcaattttcttcttctcagatgctgtgccgcttgccttgctggcagttgattcatttttgctgccgcaagctgccgccgtcagcgcgagaagcaagattaataaggtaagagatatctttttcatctatagagcctcctgttcaattgataactattatcaattggaattatagagaatgaacagatataacaccatggacaaattcctgatttatcatggataatctccggaaaataaagaaacagtttgctgaacgatgcgttcgtgcccgcaagctgagtattcattccacggatcaagggatagaagataaacacggttattccgtaccgcgcttaggttttgccatgcttctgtctgctgtaattgctggtagtaagctatggtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacacttcggttatgagccagatagaagttttgcttatgcagcctcaaaaagagaaaacgcagcccttgaacgtgctgaagcgtttttttggcggctgttgtctgctggtcataatccgctagccacttttctgcttcggactcctcctttaaaaatgaggcagtttgcagaaagtgggttctccagctttcttctgaaggaaggtacatgacttctgcgatgcgattcaggcgatctttttcttctggagaaatagaatccatgctgacaatcacatctggttctgcctgcgataacgtgtacaggttttcttcccacttttcattaaaccggtatgcactgagctggacgggtatatctgtcgaataatgctgatagtagtaagacgtccatttcggatgcagagcggccgcaaaaggtatgtggtgaagagggatgagatggcccattgtgccccttccgtatgcggcgattttctttcggcgttttttcatatagcttgtaggtgaacagcctgtatattttttaaagattctgctgaaataaaattcatcttgataaccggtttggtgtgcgatttctttcaatttgcagtttgattttgccatgagccgttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgggtttcgatatagtgttttgttttttcgattgctgaatgtgtatccgtttgatcagataaactggcagtaaagaggtcataaatcaggctttgtacttcaatcacacattttagctgagaaagctgagacgattcattccatagtgcggcaagctcttgaagccggactgcaagattttcgatatgtgaaacattcataagcttcaggttggctaattccgattctgtgcacggtgtgaaaatatcttgcccggtttccttgatatagctttgaagcctgattatacaggcatctatatgtccatcggctgctggcgtaaagccaaaggtctcgttaggcggacaaacataaagtgtctttttttgcagaggattggtgtttgttccaatcgaaatatagccgtttccttttaaatgaaaaatcagcacgaatgaatcggctaattgctgttctgagaagagatcacttgtcttttttagatattcaatttgtatcggttgataaatcactgcattttgcacgagtagaccaccttttcagaaacattcaattgataatcattttcaataaaaattgtaccaaataaatgaaagttttcctatataaagcgggtggttttttagtatgaaaaaaacccttacttatgtgtaaaagtaagggtctttcgttcggtaagaatatgttacacgtgtaacatacgatgcttacgttctaataaatgagataattttttcttgttttgctgaattgttggagtgttttttcatagctgtttatgatgttctcaaccgaagttccattttcaatttttgtcctgatccagccgttgcctgccagtttatcgaatgaacctgttgacaggaactcaaaatcctcaggatagagatcgtgtaaggttttaatgaatgaaagacccgttttaacggcttcaaacttatctctgtctgtcacatagagctgcacaccgtggcaaagcgttccttgatgtttagaaaacgtcggtgtgaaggatgctgccctaaatgtaacgcccggcaaatggaggctgtttaatgtttcttcaagttctgtgcttttgataaagggagctccgatcaattcgaatggctttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatttttcgtttccagtgtttcatttttaccactgtaagatcggcatcaatatcaaattctttgttgaacagtaaagccaattcgcctatcgtcatcccatgcttcaatggaatgggatacaatccgacaaatgaggcgtattcaggttctaagattggcccttcaatatgattcccgccttggggattcggacggtccagcaccataaatggaatgccgttttctttagcggcttccattgcgtatgccattgtataaatgtacgtgtagaaacgggtcccgacatcctgaatgtcaaacattagaatatcgacatttttcagcatttctggagtcggttttttcgtttttccgtagaggctgtatacgggaaccccggttttttcgtcaatgtaagagcctacttcgtctccagcctgggcgtcacctcggacgccgtgttcagggccgaataaagctgtcagtttgatatccgggttctcgtaaaggatatcgacactgcttttcagagatgcgtttactccggttggattggtgatcagtccgatacgttttcccttgagctgttttttatagtctggcaagagcgtgtctataccagtttggactttaggttttttagccgtttgattctttgaatcgggtgaagcagaggcagcggttatcgttccgaacatcatgagccctgtcagaaaagcgaatattgtttttctcatgtgtccctccttattaaagcggttttcccgttttgatatttaatccgtagccatatggataaagggtgtcccccgggttcgtgactgatgggatgtcaactggaagtgtgcctttaggttttgcctggccgaaaatcgccatcactccggccggaatattaggttgaagataacggccatttgcgtatcctttaaagccatagactgcaatcagtgcctttgcttcttcgaaattggctgcatcataggggttgcgcaggctcattaagacaaatggtttgttgtgctgcagtgcggctttcatgacagctctcggaaacacggtggcccatttgcttgaatctgatattgtgtcgtcgatgacaccgtcgttgacgacagggtcatttttgacgacataggagccggttatgatataatcagccttttttacttgttttgcatgctcggcattaaatacttggttggcaaaattcattttgtcgacagatacgggtttgattttctttcgcttgatgagatcgtgaatggtttgttcgattgaagcagtttgttcttcgtaaggtgcaacaattaagatgtggctgccttttttaggcttgaacggcaaagtgtgctgttcattttttaatacggtcactgctttttcagctatttttttctctgctttgaggtgacgcttgcttcctacgattttttgggctttggctattttttcgtttgtactgtcgtcatttcgcgctggatacatgccgcgttttattttcagggaaatgattctttcaactgatttgttgatttgttgttcagggatatccccgttttttacggcttctttcaaagcttgaataacacgtgcgaatttctgttcttctttcattgaagtgactgaggctggcattaatgcaatatcgacaccagcttttacggccatgaccacagcctcttcctgtccgaaatgatctgcgattgccttcatattgagtgcatcggtaacgatcacaccattaaagcccatttcctgacgaagaagacctgtcatcactttttttgaaagtgtagctggaaccagaatgtccgatccatcgagtttgcttttgtaagtggtgtcatcaaaggcgggaaactgaacatgggctgtcatcaccatatcagcaccagcatcaattgctttttgaaaaggataaagctcgacctcacgaagccgttcttggccatgggagacgagcggcagtccataatggctgtcaacgtccgtgtctccatgtcccgggaaatgtttgagggcagacgcgatatcctgccgctgcaaccctttcatcgtgtataaaccgagacgtgatgtcagttctcgattggagctgaatgaccgtacgccgattacaggattatcgggattattgttaatgtccacgacagggctgaaatctgtattgatgcctaaggcagagagctctttcccgatgatgctgccggtctgatacgcattgattctgcttctggctgcgcccagcgccatattccctgggaaattagtgccctcccctaacctcgttacaatgccgccttcctgatcaatactcagcatgagcgggatttttggacttgccttttggtaatcgtctgtcagttggacagtttgttttgttgtttttacattttctgcaaaaaggatgatgcctccgaattgatatttcttgacgaggctggcgacttcatcattcatttctgtaagggcttgcggagaggactcgccttccttttgccaatttctaaaatcaggcatcagcatctggccgagtttttcatctaacgacatacgattgacaatctgattggcatcgattgaacgtttggatgcagaggcttctgtctgtctggccccgaaaaagcatgaaagaaagagaacggctgaaaggataagcggaaagacaggtctcatagaaacttcctcctatcgtctaatcattcactccatcgcttcataaatcgcggttatgacacttccataactgcctgttgcaaattgatcaccctcaaagacgtttggattttcttccggatcaataactggtgtatgctttttatttgttaacaatgcgatgcctaaattgtatgctggatcaataattgtaactgtccctgtccagccggtatgcccgtaagcattttcactggcatgagggccaaacatccattccatgcttttacttccgttccgcctccagccaagagcgaatgtcgggtctgttgctgaaggtgctttaaacaggtcggctgttttctgatcaaataaagaaatgtttcggtatgaacctttgtttaacatgacttgcagcagtatggccatatcatctgcatttgagaacaatccggcatgcccagacacgccatccattgagtaaaacgctttttcgtcatgcacctctccttgcagcgtgtttgtgcggatgttagggaattgaataacgccgtcacgtgtattgcccatgcgttcagtagctgcgaactgtttcggtttaaagcccttttgcagcggattgtacaaggtatgcttcagcctgagcggtttgtagagctcttgctccgtgtagacatcaagcggtttgccggtgagtttttcgacaatacatccgagtagcatatatccaatgtcactgtatacgtgctttgtcccagtttggtaatcgagcggaattttcgtcaaatattcaatcgttttgtcccgttcctgggaatagtacttgccggctttttccggcgtgtaaaagtaaaagcttgatgggagccctgattggtgctggaggacatcgatgacacgtatcttgtcttttccttttatgaggtcacccggctgatccttgaaacccggcaaatatgcagaaactttttcatagacgtcaagttttccttggctgactaagcgctgcaatgcaaaatttgttgcgtacatttttgtatttgaggctaagtcaaacatcgtgcgggttttcattttggccggacggcgcagcagttctgatccttcgtactttttactgtagccgtatgctgctttttttatgatgcgtccatccttcaccaccacaagaacggcgcctggaaatcctgctgcaatatcccgttctatcatctgatctaccttccttagcttcttcgtggagaattgtgcagtttctgcatttatggttttcggctcaaccaagttgtctgctgtttgtgcgaaggtttcatttggcgcgaatatcgatagggttaaaatggcactgaatatgaacagtgtctttgttttcacaggctagcccctttctgtgcttctatcccgtttactatccctaaaacagaaacaatttaatcgaactgagaagccatttcatctttatatccgaatgcataggtcaataaaaagccggccgcgtaggaaataaagagcccaacgatatacaggatgatttgcgaaggcaggactagaaaagaaagcggcagtccggagacaccaatcgcaatggtggctacttgaaaataagcttgaaaggcgccgccgattccagctcctaaacatgctgttaaaaacgggcggccaagcggcagcgtgactccgaaaataagcggttcaccaatgccgagcagtcccgatggaagcccgccggcgattgctttcctcagtgttgtttttttcgtcttcacgaaaacggcaaaggccgcgcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcctgcagcgatgccgccgatgtccaggatggacagtaggccggatgtaatagcatcagaaatgaatccgcctaaaggcataaatacgacatacgttacgattccggtgattaacagtgaaacggtgggtgtgacaatgatatcgagtgattgaggaataaaacggcgaataaattgttcggtgtaagcaatgaatatggctgcgaaaaggacgccgatcagacctcccctgcccgggagaagctcttctccaaataaactgatttttgcgatctccggattgataatcaagatcccggccaaagcaccaagtgcgggtgtcccgccaaattctttcgaagcgttaataccgacgagaatgccgagataagtgaacagccctgatccgatgactgtcaggataaccgcaatttgtgagtctgcagagagccagcctgcttgaataattgctttggtaatcccagtaattaaaccggaagcgactagagcgggaataagagggataaaaatgctggcaattttacgtaagaaaagtttaaaaggagtggcgttttttcgattgatatcggctttctttttggccgctgcttctttgacatcggcaccttcttctactgacacgagctttgagaaagcagctgtaacatgattgacgactcctgtgccgaggataatttgtaaggtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagatcaaggattttctgtgcgagatgatggtagttattttctttgctcattaaaacccctccccttcaagatgccttattttattctcatagattgtatggctgctctcgttttatctatataaccggttgtcgtttcatactgctcagccgccatgcctaaaaacaaaacatcaattataaaaagctgggcgaggcgggaggaagtggctgcacttcgaatcaaggcttcattggaatgggctgtatacaaagggacatcagccagtgcggagacggatgtctgactgaattgtgtgaggctgatcgttgtgatgcctttttccttagccatggcaaacagttcaatgatttcctgtgtctctcctgaaaacgaaatggcgaatacgatgtcgtctttatctgcatttgcgattaaagatgccacaagatgagtgtctgtaaacgcggttgcttgtttatgaatgcgaagccacttttgctgggcgtccttggcgacaatgccggaagccccgaggccgataaaatgcacggtatgagctttgagaagcagagaaaccgctcgttcaagctctttgtagtccatcaggtctgaagtatcctgaatggcttgaatggcattgccggccgttttttcggaaatggagggcagcggctcgtggggaacaatatcccggtagccctgaaacgtaggctttgccagatcgcccgctactctcatttttaaatcttgaaatccttttaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatcgctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatctggctgtgtcgtatgaagcgtttgtaaggctttggataatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggagttttcattgcaagtaagggcgatggtgtgtgctccgacttttcgggcgtatcttagggcgcctgcggcgtacggtgtgcggccgcttgctgcgatggcaatgacggtgtcatttgaagtgagctgtatgtttcttaaatcttcagctcctgcttcttcactgtcttcaatgccctctgctgcctgtaaaaaggctttggggcctccagccatgattccgatgacctgatcagggcttacgctgtaggtaggaggacattcaacagcatccatgacgccgagtctgccgcttgtgccggcgcctgtatatatgagccggcctccattttgaaacgattcatatgcgcagtctacagctgttttgatgtcggggagaacctcctgaacggctgcagcgactttcatatcttcgttgttgatcattttgaggatgccaagagtgtttgctttgtggatttcaactgtttggctattgcgtgattccgttgtgagacggtgaagatttaatggttctgacatgaggatgccccctgttttaaaatgatatatctcaatattcagtatattcatctctgttatgatatttcaactatgtttttaaatttttgaaattttatttcactcaagactataagaaatgatgaaggatcaactgttctccaagcgggccgattcttcgccgtcctttatcaaggaacccgcttttcatataaaggtgttttgcgtgtatgttcagatgattgacggccaagatgatttcgtcgcaccatggaaaatatccgctcacaaaagcgggaagcaaaagcatggcttttttcgcatagccttttccgtgatgcgcagcgtttaaagacagggagctgagcagtaaagcaaatggattgttagaataggaagcaagcgtttcttttgatgcatgtaaaatgaaaaaaccgactggaaggtcgtcttttaagatgacaaccgggtatcggtcctgtatgcccagagcctgagacagcacctctttcgggagggaggtaaagcgtttgtcatcgttggtgagcgtgaatgattgaagctcgggcaagtgttcaggcttatagaaggataaagaaatgtcttgagtcatggggtggcctccttacaatatgtcgtcaagctcgttttccgaaatgacgcggtagcccgcttgttttaacagtgcggcggttactccgctgccggtgatttttttcccagagaatgtgccgttatagataaaaccgcttccgcaagatggactgttttcttttaatatgacggcagaagcgttgatttcttttgcgtaagccaatgttttcgcggcgccttccatatatagttctgtgacgtcttctcctgaagctgtcacgattttcgctgttccattgaggacatcctcgccggtgcctcctatgatttctgcgggttcgcgtggggtagagaagccgccgagaagttcagggcaagccatgactgctttcttttcatcgactagttttctgattttctccgacgctgcgtgagagccgttatatctgcattcaatgcctccaaggcaagaactgactagaatcatattgggttctcctctcttgctttgcttgtctctatcataaaataaatggctttagttgggaggctttttcagttaaaaaaggagttaaaaagtttgaaaataaaaaatttaattttcctctttacaaacagggggtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaaggtgtcttttttcttttcggaaaaatcattccaacttctaactgttcagtctgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggcgaccaggatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaatgaacatctggagacatgcgagaaatgcagaaagcatttttacgagatggagaaatccatagcgctcgtacggagcacatcgcatgtcgaagcccccgcggattttaccgctaatgtcatggcaaaattgcctaaggagaagaaaagagcttctgtaaaaagatggttcagatcccatcccgttatcgcagctgctgcggtattcatcattttgatgggcgggggtttttttaacagctggcataatgaccacaatttcagcgtgtccaagcagccgaatcttgtggttcataaccatactgtgaccgtgccagaaggtgagactgtcaaaggtgatgtcactgtcaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcagtccgaacggagaagagtaaagcgcgttagccgctttgctctttttttgcgggctgagagggctggcacatttcacttgctaaatcgaaatgtggtataatgggctcgctatgtaaagtacatatgcgtaacccgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgcggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccctgctgaccattgagcgggatactggaatgggggattatattgagaccggcataccactaaatgccaaagtcagctctgagctgctgatcaatatttttattccaaacaccccgcttcatgacggtgcggtgattatgaaaaataatgaaattgccgcagccgcctgttatctgccgctttctgagagcccgtttatttcaaaggaactgggcacgcggcacagagcggcagtcggtatcagtgaagtaacagacagtttgacgattattgtgtctgaagagaccggcggcgtcagtgtggcaaagaacggcgaccttcacagagagcttacagaagaagcgctgaaagaaatgcttgaagccgagtttaagaaaaacaccagagacacttcttctaaccgctggtattggaggggcaagaaaaatggataaattcttaaacaaccgctgggctgtgaaaatcattgctctacttttcgcgctcttgctttatgtggcggttaacagcaaccaagcaccgactccgaaaaaaccgggtgaatctttctttccgacatcaacaactgatgaagcaactctgactgatattccggttaaagcgtattatgatgatgaaaattacgtcgtgacgggtgttccgcaaacggttaatgtcacgataaaaggctcgacaagcgccgtgaaaaaggctcggcagaccaagaactttgaaatatatgctgatatggaacatttgaaaaccggcacacataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccctttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgatagtgaagcggatcagaggttcgagaatgtccctatcaagactgtagggctgagcagctcacaaaacattgaatttcttgatcctgaatcacaagcgatagatgtaacggctaaaggctctcccacgaatataaataaactgaaaaaatcagatattgaattgtatgtgaatgtttcagatttagaggacggggagcatagcgtgaagcttgaagtgaacgggccacagaatgtaacttggtccttggggcggaaaaccgccaaaatcaagctgacgtctaagaaaagcaatacatcaacgaatgataacagcagcaatacatcagggaaccaggatgacacagataaacaaacaaatgatcaaaagaacaatcagcaagaagatacaaagaacactgataaaaacaacaacgatcaaaaccaagacgaaaataaagatcaaaaccaagatcaggatgaggatgaatccactgcaaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctgggtgtcatttctacaccaggtgtatcttatttgacaaaagcgatggatgcagaggcgggcgtcatgatttccgcttctcataacccagtgcaggataacggcatcaaattctttgggggagatggatttaagctttctgatgaacaggaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgcccatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatctcggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatacagtggtttcaaccgtgatgagcaacctcggcttctataaggcgctcgaaaaagaaggcatcaaaagcgtacagacagctgtcggcgaccgctacgtagtagaagcaatgaaaaaagacggctacaacgtcggcggagaacagtcaggacatcttattttccttgattacaacacgacaggggacggattattgtctgctattatgctgatgaacactttgaaagcaacaggcaagccgctgtcagagcttgcagctgaaatgcagaagttcccgcagctgttagtcaatgtgagagtgactgataaatataaagttgaagaaaatgaaaaagtaaaagcaattatttctgaagttgaaaaagaaatgaacggcgacggccggattttggtgcgcccttctggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggtttacataagataattgtgagacatacggcaaagttgtttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtgtgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagaaaagcttgagtatcgcggttatgactctgctggtattgctgttgcaaacgaacagggaatccatgtgttcaaagaaaaaggacgcattgcagatcttcgtgaagttgtggatgccaatgtagaagcgaaagccggaattgggcatactcgctgggcgacacacggcgaaccaagctatctgaacgctcacccgcatcaaagcgcactgggccgctttacacttgttcataacggcgtgatcgagaactatgttcagctgaagcaagagtatttgcaagatgtagagctcaaaagtgacaccgatacagaagtagtcgttcaagtaatcgagcaattcgtcaatggaggacttgagacagaagaagcgttccgcaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcgatggcgatgcttcaagtaaccaacgaatatgttgagctgatggataaagaaatggttatcgtcactgatgaccaagttgtcatcaaaaaccttgatggtgacgtgattacacgtgcgtcttatattgctgagcttgatgccagtgatatcgaaaaaggcacgtaccctcactacatgttgaaagaaacggatgagcagcctgttgttatgcgcaaaatcatccaaacgtatcaagatgaaaacggcaagctgtctgtgcctggcgatatcgctgccgctgtagcggaagcggaccgcatctatatcattggctgcggaaccagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggttctcgttcaagtcaaagcgcttggacacaaagccctgacaatcacaaacgtacctggatcaacgctttctcgtgaagctgactatacattgctgcttcatgcaggccctgagatcgctgttgcgtcaacgaaagcatacactgcacaaatcgcagttcttgcggttcttgcttctgtagctgctgacaaaaacggcatcgatatcggatttgaccttgtcaaagaactcggtatcgctgcaaacgcaatggaagctctatgcgaccagaaagacgaaatggaaatgatcgctcgtgaatacctgactgtatccagaaatgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcacgtaaacctaagcatccgcggaaacgtcaaagaagttgctgctcgcggagcaaacacatgcatcatctcactgaaaggcctagacgatgcggatgacagattcgtactgccggaagtaaacccagcgcttgctccgttggtatctgttgttccattgcagctgatcgcttactatgctgcactgcatcgcggctgtgatgttgataaaccgcgtaaccttgcgaaaagtgttactgtggagtaataaatgtttaacccctttggataagattatctaaaggggtgtttttatgtccaaaagagaaagaacgtctacagtggaaaaatggattaaagaagttgatggtacaggacccgactatcgatcggccatagctatagatttaagatgtttccacataaggtcggtcaatcaggttaaaaggcattaagacttttgcctaactgagttttctgatgttaatacagatataagagagcagttcctcattaagatacgcttttgatagcagttggaatttagcatgctagaaatccgaaaaccggagagcctattggaatgataacgtttttttttattgtcaattaataaaggcaaagaattctagaagtcgcacttacaatgtacttgtaggccttaggttttaaagctcattctttttttattgagtacattccggtttaagttgaaatgattcagtaaaggacacgccataaataaaaggtagcgtatgactcccatgttttccatgaaaacgatatttctaagatttcatctttcgtaggctttcgattcatattacgtaatatttttatcgaacgaattagacccacatcatcgattggaaaagctgtcgggaacctaaggcagcgcattagaacataattggctgtccaaggaccgattcctcgtattttaattaagtttttttcagcatctttaaagttcattttcattaatttttccctcgataattccccacttgccattaatctggctattccaatgatatattcacttttttttaccgtcattttatatctgccaggtcggtaggggttaaccgtgcaattcgctcgtacggtgggaacacccaatactttttaccattccattcaatagaatcgccaaatgcttctacaaattgcttctttaaggagtacgcgaaggctaagttaatttgttgccctaaaactccccaacataaagcttcaaataaatcgggaatgccgatcactcgcaacccataaaattttcgggcaggcattttaagtaatggatctgcttttgccatttcataaaatggagttaaatcgttatcaagatcaaaccattcatgaatatattttacaatctcttcccgtttccactgctcaacaggtctagaatcgtttaggaattgaacaatcatttgtttattattgattacgcttacctgcactaaggaccgaatttccccaatggctataacttttgtaatgatattgttctctatttcatacatgcattcatttttttccctggttaggtagccaaggttagcattcatgtcgaaaatttcaggtaatgtaatgacaataacatcattgacttcatgccatgccactttttctttctccttatcttaaataattataagaaaactcacgctggttgaaattagtttatcacataatcatctttactcattttgttatcttgctattacattctaaccatcttatttttttctatttatgaggttatagtgtagttatcaagaatgttaaacgggagtagataaaaatggcccaagatataaaaatcgcgtgtcgaaaatttaaattgggatttaattcaaaatgaattagatgagccatgtaaggacaggtgagataaatgccggataatatcaataacggacataaagagagccatgatcatagaattttgaatgatgcagaaataatatcaagcaattataaataatgatgcaacgtataataatcaatttttctacgctgtaaagtcgacaggggtattctgtaaaccatcctgtaaatctcgtgttccgaaaaaagagaatgtatgtatttttccaaacgcagaacaagctctccgcgcaaattttcgctcttgtaaacgttgcaagcccactaatgaaaaaatgcctgatcgcgagtgggttgatttaattactgaatatattgataaaaatttctcagaaaaattaacgctagaatcgttagcagatatttgtcatgggagtccgtatcatctgcatcgaacatttaaaaaaattaaaggcattacactggttgagtatatacaacaagttagagtacacgcggctaaaaagtatttgattcagacaaataaagcgattggagatatcgctacatgtgtgggtatggctaacgcgccttattttattactttatttaaaaagaaaactggacagacaccagcacaatttcgtcaaatgagtaaaatggaggaaacgtacaatggaaacaaagaataaagcaaccctttattggtctttattaatgttcaaggattggaatttttatattgcttcaactttaaaggggcttgtgtttgtaggctcacagaacaaaccaatcgaggaattgttcgaatgggctaagaaacgctttccaggaagtcttcttgttgaagatgatgataagcttgaaccctatgccgttgaaatcactcaatatctagaaggaaagcggaaaaactttactgttccagttgagtacgccggtacgcaatttcagatagccgtctggaatgcactttgtgaaattccttatggacagacgaaatcctattccgacattgcaaatgatataaataaaccagcagctgttcgtgctgtaggtgcggctattggggctaatccggtattaattactgtaccgtgccatcgtgtaataggaaagaatggctcattaactggctatcggggcggattcgaaatgaagacactgctcctcgatctggaaaagcgagcttcatctgaaatggatgttcctcattgaaagtgaatcatctatatgggttggattattttagaggaaagtaaagaccagtttactgataaacttgacaacttttaaaatttagcatatcttatacgtaacttaataatcgatgccgatgtttatttttccttttaaaatatgtaggcctttagcattcttttcatatttcattttaaatattgataggatgaaaaagcatcctaactaaaaaggaagagaaacataagtcgatttatttgataatcaggactatattaaaggaaattaaacatagcataaagtaaagaccaataataaggtagctcttcaaaaaacttcgctgaagttagttgaagtgaagccgacaattttcaggattcaatgatctaacataatcattgaaattttgaagttgtcggcttttttgttggaaaaaaatagagataaataaaaattgaaataaataatagacaaatatgatctgattgaaaggtcttttgaccaataatgagttttaaaaaagggagaatttagaatgttagtttcgctgagtttgtcatcattattaacattattttttattatgcttatggcttctgggattagtggactattgtttttacatccgcgagtacccttgagttttgttcgcattcatattgggatcttggctttaccacttttggtttccttactgattcttgccaatagtggtgtgagtggaaatgttggcccttggcacttagattccttagcttgtttaatgactttctttgttcttgcaattggattcatcattcagcgtttttctgtacgttacttaatgggggatcgatcttatcgaaaatattttacgctttttactttcacaacaggagctgcttcaatgacatggttaagtggtgatctccgcttgatggttctattttggggagcgactcttgttggattaaccttacttattaggttaaacagtgcttggcaagtggctagtgaagcagccaaaatttctggacggttatttttgttaagttggttttctttgttttttgcgatgacgtggctttttcatgccacaggtcaatggcagttatcattggttgtaacaaatgaaagtatagctgggctgggagaatgggagagaacagggattcagctattgattgtactggcggtgatcattcctgcagctcaatggccgttccaaagatggttggttgagtctattgttgctccaacccctgtttctgcaattatgcatgcaggtttagtaaatgcaggaggaataatactaactcgattttcacctctatttcatggtggtatcgcttcgattatcttacttctgcttgctagcatttctgtattgattggaactggaattagtttagtccaggttgattataaacgtcagttagtaggctccacgattggacaaatggggtttatgctcattcagtgtgcattaggcgcctatatagcagccattattcatcttattttacatggtttattcaaagctacgttgtttctacaagctggttcagcagtagggcgtcatgaagtattggctcgcactaatgaaagaacatcctatttatgggtcatggctggtcggattttatccttagtaataggcgttgctttttggctcgctgctcctggagaggtatatcaattcattagtgcgctgatcttagggtggtcattgtccgtttcttggaatcagcttgtcgcttttggagagggtcgaattggccgaattgccggcttaactgttttaggaggagcagccctcgtatattttatcattcataaccttttctataagtggctgcatacaaccatttttcaaagtgttcaacctccaatgtcagctgtcatgattgtcgtatgtctcttattatttggcagtgctttaggtacatgggttgctcgttatcgttcttccgtttttttcgcggtgctctatctttggttagttcgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaagggatcttaacgttttcattacatctgccagccgagtgattgcgccactttggcctatttctacatttgctgcacgtaatccgtggatgggacttgaaaaccaaccttttgatcaggttgcaagttggttgaaaaacactcgcgatgttgatatataccctagtgcgtctatgatccgttcagcaaagaataaaggtgagattgatgaagattttgtggaaatggggctgcagcgttggcttgattcacattcttatcacatcccacgggacgtggcagagcgatttagtcatgctgcattaaagttagatcccctgccttccgaccttttatcatcacatgagctggagaaattagtaggtgaatgtagtggattggatcatatcgagaatgtgtttatgcagccactaagttcgtatatagagaatcaagatggtgaaaggctagtcaatatactagatcatcatgtcattaagtggagtaaattatatcttgatgactctcaagcaggctggacaatgcctaatcgtgaggaaggtttctatcgtgcttggcagcatcttattcaatatgatccagcacttagcaaaaagcaacgggaaagggtaaagggttggccgaaagaggcacatttggctttacagaaagctttattcgcactagaaatcccagagtcagaaatccagacttatcttgaaggtcatttactttcattacctggatgggcagggatgatgctttggcgctcccagcaatcgagccacgaacatgcactcctaacagaatatttagcggttcgaatatccatggagtgggctcttataaagccatatttacctttgactaatgaacgatctaagaaaacaatttcaattgctccccttatagcagcttggattcattggggtgggcttacattagaagaatggtcacagatgacggccattgaacaaaacgaatatttatcatttgcctacagctttgatgagaaacttcgcaagaaactttggttagaagcttgggaacaaacgtacactgatcgattaagccagaagatcatctcgaaactacgtgaaaccggccgtaaaaaatctgcattagctcaattagcattctgcatcgatgtacgatcagaaccttttcgtcgtcaactagaaaaagaaggcccgtttgaaacgattggtattgctggtttcttcggggtgccgattgcaacttgtgaacttggcagtaaacacagtcatgcttccttgccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagcggaccttggcttacactgcaaatggcagcccgtagctttgtgccaagaaaggcgggtcgtttcattcgtaatctccgtgaggcttggttacgcaaacctgatacaaaactctcgcttcatcatgatgctacagaggcagaaatacctgtgggttttactgatgaagaaaaagtgaactatgctcgccaagcattaaaaatgatggggttaacagagaacatcgcaccattggtcgtgatttgcgggcatggcagtcaaagtactaataatccttattctgcagcccttgattgtggtgcctgcggtggagcggccggtggattcaatgcaagagttttagctgctttatgtaatctatcagaggtacgagaagctcttttaactgaaggaattaaaatccctgaggatacggtttttgcagcggctgaacataatacaacagtagatgagttacattggctttatgtaccagagctttccgaagctgcacaagaagcatttgaacaaattgaagccgttatgccgaaagtgagacatcatgtaaacgcagaacgtctagcccaattaccgaatttccaatcgaagctaaaaaatccgaaggctgaggcaaaccgatttgcggaagattggagtgagatacgtccggaatggggactggctcgtaatgccgcctttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcacctcattattatggcagcggaaataaagcaactcaaaccgttactgcaggtctcggcgttatgcaggggaatgcaagcgatttgttagccggactgccttggcaatccgtcatggaatcagatcacgaggcctatcattctcctcttcgtttattgatactcatccaagcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttactcaatacaaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccagtatttcacatccttatggagaaattatgaggtctgttatttttgcgatttaccaggaagatgttgagaagatttttgtagtaggaacaaaagataagaagacttccgcaggtaatggactaactcaacttgaaacaatgaaagataaaatacaaacattggattatctctttcaaaattgcaagcctgaattttttggtggtacggtcgatgaatggctaaatgaaaatagcagtgacaccattgaaaaaagtgttgatatgattcgacgtcatcccctagtgccgtcatatgttaaagttagaggtttattcgttcatcataatgatggaaaaccctcaatcgtgaaggttcctgatgttaaaacaggtcaagccttacctgatcattgcttgtcacgatgaaatacaggttcaacttctaaacgcacccatatatggagaaagcagttctaaggagattgtatgagcgctaatttaactgattttgtcacgaaaacaatcgaggaaatgaactcgtttgatcgtgaaaatatggaatgtatgaaaaaactaattagaaaagcaattgatttttatcatctaaaatcttatgaagaagttgaggaaacccattcaggaaacgttcgatttttgcatgtccactctatgatggaagaaaatatgttatccaaaatgatagtggtcacaagaaacggtaaaactgatttggatattgaaggtgtatatgaaggatatgttgtaagagaatattaatagacgaaatcacaaatagaatatgccaatttttttgctcaggagatgtattagatatgaaaaagtcgaagggttctattgaatcagagatcagtaagtccattactcaatgggagaaggattatcttgggcgggggtctgtatctgttaagactgatatactgcgggacatgatcatcgtcaatttaaaagggattttaacaccagctgaatatgtagtttgtggatcaaaagagggtatgttatctatcaaacaaactcgttcggagttagtcgaatcaggtatagaaggccttaaggatattatcttaaaaataaccggagaaaaagtgaaaagttttcatactgatttaagctcccggacaggtgaacgagtgatggtgtttaaattatgtaatgatctagagaaaaatttggaaaagatcttataatctaaagaaaataaatgttttgacggtatggaatttgttgtgaattgaacataatgaactgccgattcttttgttttacaattatggcatcattgataacttttattcatatcctaagcggacataaagagatgtcaattcatagtatactgtcttgttattcctgtcgaaagatctaacatccgctgttgttatgagcggatgtttttttacatctattttaaatacatgaatttgatgctggtgattagtcacttgaacaatatttgaaaaaatccttgtcacctgccgggttcccccaagtgtttagtgacacgattatgagaccaatttcgtaaagcttgatgatgaatttaagcggtgaacaaaattgatatgctgtcttcagtttcaaaaaacggattgacatatcgaaatataacgatataataatcgatatggaaccaattgaagtattcaaagccttatcaaatgaatcaaggctgcaaattttgcaatggctgaaggaaccggatcgtcattttgcaccccatgaagggattgatatgaacacaatcggggtatgtgtcagtcaaataacagacaaattgaaaatgacgcaatcgacggcttcccaatatcttaccatccttttaaggaccggcctaattaaggcggaacgaatcggaaagtacacgtattacaaaagagatgaagaagccattgggaaacttgctgactttcttaaaacagagatataaaaataaacatcttttgatgtttatttttacaccatacatatcgacatattacgatgtgtttatattttataataacatatcgataattcgtgatatgtttattaataattaaggagtgaatgttttatgtctaacacttggaaaatttatattttagccattgtcagctttttagttggaacctcagagtacatcatttccggaattttggatcaaattgctcatactctcgggatcactttagctgccgcgggccagcttattaccattttctcacttgtatatgctctttctacacccgtacttatggcgttgacagcaagtatggatagacgcaaattgatgatgtatgccctaggtttgtttgtgttcggtaatgtcctggcttttgtactgcctggttatggatggtttattgcagcgcggatcattatggcgatgggagcaggtgtggtggttgtcaccgcattaacgattgccgctaagattgcatcggaagggaagcagggaagtgccatcgctacggtcgtgatgggatttaccgcttctttaatcattggtgttccgcttggaagaatgatagcagtagcattaggctggaagtctgtatttggagcaattgctttgttgggattgatcgcaatggtcgttattttctttactcttccgcatactgaaggggataagcctgtgcctttgcttcaacagcttgctcttttcaaaaaacggaaagtggctatgggattatcaatcactttcttctggctcgggggatattctgttgcttacacttatttgtcaccgtatctcttgaacatctcaggtataaatggcaagctgctcagcggtgttttgcttatatttggaattgccagtttggttggatcaaagtttgggggatatagcaccgataaatggggagtgccctttacactcgttggcgggatgacgttgcatatcgtcacactgattcttctgtcacttgttactcattcctatatcggagtgttggtgattcttatattatggtcgtttgccgcatggtctacaggtccgacacagcaatttcacctggctaccatagaaccggaaatgtcaggtgttttgcttagcatgaatcagtcaatgatgcaattcgccatggcggtcggcgcaggtataggaggggtttttgtggaaaacgtatcattggcctcgattacctgggttggtgcgttaggggttatgattgccattattgcatcattgctgattttcaattcgcaaccgaaacaagcgctaaaagatatcaatcaataatttcgaaagttctaacatccgctcgttatacaagcgggtgtttttttaaaaagctcaagtagaaggcacactgaagctgaaagggatttttgccgacggagagctgaagcacagcaagttataatatactaggaagggaaataacggtatagcggaagggttctagcgcttctcgcctgtaagatcattactttgaggatgtgtcatcgtgaatcaaaagacgtacattgaaatgagcaggacatcgcagtacatcaacaaaatgagagagtattcagtgctaattgatggggctgagatgggaactatcaaagatggaggaaggttgcgaattgatttaccgcctggtgagcatgttattcaagtgaagattgcttggtgtacaagcccaactttgaggtttactttagcggaaggagaagtgttgaagtttagatgcggaagtccgcttcgaggttggaagttgcttttggcgcttttttctgttttggcccgtcctgaaaattatctgtttatcgagcaggaagaagagaaaaaagctttgtggtgactttgtgtgaaagaataccgctgaattacgttttgtatttaagtggaagctctctccttggaaggctgagataagagattctcgtctattctttttctttctcctataaaatttatataatagggagaaagaaatggggtgaacatcatatgtttaaaaaaatcatcaaaacgattaagtacctctcaagcagttctagtgaccgatatcgcagacatcggcattacagcagcagccggcgcagacattatcgcagctacagcagcagctcgggcaaaagaagacactacgaccgttatggcggcagtcatcgttacaaacgccggagctacagcagcagttaatccaaaaaaagttcttgttccgcttttgggacaagggtttttttatatgaccgattgaatggcccggtttagatcctcgcgaatggaagcggtgtgctgatactcttcctcaatgcccaataatcttttcagcagcagggttacttcctttgtcagtgttaattcctccagccaagtgccgtttttcttcttttttcctttatattgagagtacagcaggaataatagcgtttctccgagatcgaagaagtcatcctgttttcgtacctttatttcctccatttcttcaagagtcaattgtttggcaaggccgaaatcgatgaggcagagcctgccgtcattgatgatgatattaggcgttctgatgtcgctgtggaagataaggcgatcatgcaggtattctataatctcaagcagctgcgaaatcagttgtaacgccataagctctgtgaacggctgttttcgaaaaaataataattcttctatattctctccctcaatgaactgcatgacataataagcctgtccgtctatgatgaactcatctatgaagcccggaatttgcgggtggtgaatgcttttgagcagttttatttcctgttggaatcggactttctctttttcctttttcgcttttgtcggccgaagctgttttaagacataaggtgtttgagttaggatatcggtgcacaaataaaccaaaccgtagcctcccataccgaggcactcttcgattttgtattgatgatttaagataacgccgttctttagagggcggtcaaatagcagtttttttagaagttttaatgccatgtctgcacttcccttggttgtactgactatagtttaccttctagactgagaataaaaaagagccggataaccggctcggtataagttaaaactgctttgtcacgtcgtattcataatctatttttgcttttacgttgctcatcgtcgatctggctgtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccagattggtttgttaaatcaaccttgatcacgctggagtcagaacctgaggggctaaggcttgtatttcctttattttcagcaacgccgctgaattggaacgttccgctgcctgatttgattcggtcttcaattgaaagtgtaaaatacatgtttccggtataggtgcctcgtgacactttcacataaaaggtatctgtcgtgttttgggcgtctgcatttgcataaataaaagaagaaaacgtattagggttaatgacttctgtcccttgagaaacaggtattctattcttatcataaatttcaattttcatccctgtatacgcgctctggtatgtactcctcacgtatactctttctcccttattagccgtaaaagtgaaataggcttcatcttgaccagcttccagtattgttgtatcgatatttttatatttccaataaccgatcggcattgcggtatcaaatgaattgtttcctgtgatagcagtgactccggcagctgatgccgaatacgtaaaggtgaataagacagacagcataacagcgaatggaataagccattttttcaccatgcaaacaacctccttttatttccatcatacataataacgatttgggtgtaaataaatgtttttcgaggttaatatatacattatctttgtcgataaaaaagaataagagagaatactcgggagggaattcaatgcgtctgaatcggcaatttatacgcactcagctgatggcacagaacatattgagcaagaatgcgcctgccaaacgggagaatgcgactgaaaatccagcggcagttctggaaaaggcatacagcaggcttaagtcacaatcttcaactggggaaatcaatcagttcaattattctaaaaccggcgtggcgggaaacagcgggacgttcagcaaagtgtatcgatcagcgaatgatcgaacagtgacagacacaggggaagaaacagtgattcaatcccaaaacccctatgaatctgagagtgatatcagaaccaaaatactagatgaaaaatacagcaggatgaatgcgattaacaaaacaaagtctgatccattaggctatattaaggataagtaccaaaattcaaagtctccttatttcagaagtgatctgtcagctgcagaaagacaggccgcttacgataatgaaacagaatggctattcaaaggcaaggcccaaaactataaccttcaggatgctgcgtttcggaatgtcacatttcatggggaagtggaagctgagaatgaaaaggtgtatcagcggggacaggttaatcagcagctgcaagtgctgttgaatcgaaaccatattcatattccagaggggacagagctgacgtttacaatcacaccgattgactatcaggtgcgggtaagcgggtcagacgatcaggcactgattaagcagattgagcaagtaatgcaatctggggacaacagcaaagaactatttttgcacatcatgaaaagccaaagcagtgattcagcacaattttccgaagaggcctatcaaaagtatcaggctgctcgtgagatgtacgaagttacaggctaccatttgaaggatttagaagtgattgatgggcggtatgtcacgcctgatggacgtgacttattagacgtctataaagaagaacttgaaaaagatccagtgcagaaacaaacggcttcttatgctatatcttactatcgttcagagctcagtaaaatcgcggaagccgggtataatgccattccggatttcatcctatcaattgattacagcaatggatctctgagagatgtgggacaaagcaagagctatgggaccggagataccgggtggcttgaagcattaaagcgtcaaacgggtgtgaattattaggtaagctgttcatgtagaacagcttattttttatgagaatctaaggggtttattaatttcaatattcaaataattttattttttttatataaaagattttaaaagaagtgaacgattcaaaactctgaacaaaggtgtttacctgaaaaaaacaattgtattttccagagaaatttattatgatgaaataagtaatttaggagattatataacaatttcaagtttgaattttctgattgttatcgctgattcatgtgaagggaagcaggtctgctgttttctcatttatgttaggaggaggaagaggagtggcaaataaagaattaaagaggggcctgggcgcgcgccatattcagatgatcgccttgggcggtacaatcggtgttggcttgtttatgggttctgccagcacgatttcatggactggcccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggaaacggcggagatgcgatcggtttgtcgaacttgtggtctcacgggggcttctttgcaggaggtttctcaggtttcttctttgcactgtctcttgtcattgcggcctatcaaggagttgagctgatcggaattacagcgggtgaagcgaaggacccgcaaaacacgctaagaaatgcgattcaaagtattatctggcgtattttgattttctacattggcgctatttttgtgatcgtgacggtgtatccttgggatgagctcaactcactcggaagtccgtttgtgtctacgttctcgaaaatcgggattacggcagcggccggcattattaactttgtcgtgattactgcggcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggtgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttgacaaaaagcgaacaagcagctgaataacgataaaaaagagacattcacggatgtctctttttttatttttcgcgtatggattttccctattttagcaagctatagggtaaagatagcagaaggaaaggtgttcataaaatggatgttacactcggttatttgcgcgaatcactttcgaatcatctagaaaatgaagtctgccagcgtatttgcaagaagatgctggcgaagcgttatgcaaatgaagaggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaaggagaatttgtggaagaaatcgaatttgaatttaacggggaatatcccgatcatgatttgattgaagagcttgtgaatcattattgttttgagcatgagatttagagccctgccgtgcagggctcttttatttaggatgtaatcaggccatactttttcaggatatccacggtgatgtttttggcttttgtgccggaatcatcgacattggtgacaaagacataagagccatgctctgttttgatgaatccgacaaaccatcctaatcccatatcagtcaggcgggttccggttttcccgtagagcgtgtaatgatcgccttcctcttgaatcatcatgcgcttgacgattttcatcaccggcttgtcaaatggaagctcctctttagccagtttctccaaaaaagtttcttgttccagcggagatattgtgagcgagctttgcagccaaaactggtcgattcccccgctgatatcctcgttgccgtaagatagagtatgaagccatgttttcattctttcctcgccgatatctctcgctaatgcctgataataccagattgcggattcgcgcatggccgagccaagcgtatggtcgcggttccatgattcgaattcacgcttgaccccgtcccatcgtttaacatcgtattcatctcttacagctttgacctgcaaaccgattaaagcgttcacgactttaaaggtggattgcggagtttgtctttgatttgcccgttttctgttatagacaaatgtctgatccttttgtaaatcgtgaagaatgaaggttccatccgtatccttgaattcatcatcgacattcattttgctgacattcaagtgtttttcatgagcagatgatgctgcgtggacggagaagccgccgatccctgcaatactcagcacaagcacaacatatatccattttttcattttgttctccccttcgttttgattaactaccttttctctctttcgtttgttcttcctttaaaaaataatcaaaaagcgcttaaatttggttttgcaaacaaatactgttactgggtttatagtcggaagataacgtgaaaatagagggtaaaaaggaaggcagggtaagcggatgaatgagcagattccacatgacaaaagtctcgataacagtctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcggcagaacgctttgcctaagagggtgcagaaatcgctgtttggtgttaatgcgattcagggaatggatggcagcgcgcatatccatcggaagatgctttttctgtcattgatgacaccgccgcatcaaaaacgtttggctgagttgatgacagaggagtggaaagcagcagtcacaagatgggagaaggcagatgaggttgtgttatttgaagaagcaaaagaaatcctgtgccgggtagcgtgctattgggcaggtgttccgttgaaggaaacggaagtcaaagagagagcggatgacttcattgacatggtcgacgcgttcggtgctgtgggaccgcggcattggaagggaagaagagcaaggccacgtgcggaagagtggattgaagtcatgattgaagatgctcgtgccggcttgctgaaaacaactcccggaacagcgctgcatgaaatggcttttcacacacaagaagatggaagccagctggattcccgcatggcagccattgagctgattaatgtactccggcctattgtcgccatttcttactttcttgtgttttcagctttggcgcttcatgagcatccgaagtacaaggaatggctgcggtctggaaacagccgggaaagagaaatgtttgtgcaggaggtccgcagatattatccgttcggcccgtttttaggggcgcttgtcaaaaaagattttgtatggaataactgtgagtttaagaagggcacatcggtgctgcttgatgtatatggaacgaaccacgaccctcgtctatgggatcatcccgatgaattccggccggaacgatttgcggagcgggaagaaaatccgtttgatatgattcctcaaggcgggggacacgccgaaaaaggccaccgctgtccaggggaaggcattacaattgaagtcatgaaagcgagcctggatttcctcgtccatcagattgaatacgatgttccggaacaatcactgcattacagtatcgccagaatgccgtcattgcctgaaagcggcttcgtaatgagcggaatcagacgaaaaagttaaatcaaaaagctctcttcctttatcgaagagagctttttgattacttctttttttcatcgtagtattggacgggatacatggagccttctgataccattttgttatcctcgatatcttgcgggtccgggtggccggctttatcaactgggaacgtttccatatcgggctgttttgttattttcatcttcatgctgtgaatgaattcccttgccttttggcgatttgatgggtcttttaatagataagaagtgatgccgacagttgaaacagcgagacctgaaagtaacagcttttgtttcatggtgatactcctttctattttaagaatagtgtttcctgtatcattcccgttttggaaatagctaaacctattgtgtttttatcgttgggattaacagtaaattccatttaagaagaaactagtgacttcattcctgtattggaaggtaatatacattgacttattatagtttcagtcaaaattcgataaatattgacaaagtaaagtaatcagaataataatataattagcaagagaatgtcatcatacatgaaaggtgtttacgatatgaatcaattgcatcgaagaatgggaacgttttccctcatgatggtcgggctagggtcgatgatcggttcaggctggctgttcggggcttggcgtgcggctcaaatagcaggaccagctgctattatttcatgggttattggaatggtcgtcattttatttattgctctttcttatagtgaactaggttctatgttccctgaagcggggggaatggtcaaatacacgcaatattcacacggttcgtttatcggttttattgcgggctgggccaactggattgcgattgtgtccgtcattccggttgaagcggtggcctccgttcaatatatgagttcttggccttgggaatgggcgaaatggacaagcggtttggtgaagaatggaacgctgactggggaaggactagcgtttgcctctgtattgcttctcatttattttctgctgaactactggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttcaggtatcgtttttgcgtttaatggtttccaaagcccgattaatatggcgggtgaagcaaaaaacccggggaaatcaatcccgattgcggttgttggctctcttttcgttgcgacagtgatttatgtcctgctgcagatcgccttcattggagctgtgaatccttctgatattgctcacggctggagccatctgaattttaattctccttttgctgatctggcgattgcgctgaatattaactggctagttattgtgttatatgcggatgcatttgtatcaccgtctggaacagggattacgtatacggcgacaacgtcccgaatgatttacggaatggaaaaaaacaaatatatgccaagtatattcgggaagcttcatccgatttacggcgttccgcgacaagcaatgttctttaacttgattgtgtcgttcatctttttgttcctgttcagagggtggggcgtattagcggaaattatttccgttgctacgttaatttcttatatcaccggcccgatcacagtcatgacattgagacggacggggaaagacctgtacaggcctcttcgtttaaaaggcttgaacgtgattgccccgcttggatttatctttgcgtcactggtgctgtattgggcgcgctggccgttaacaggacaggttctgtttattatcctgatcggtcttccgatttatttctattatcaggcgaaggcgaaatggaaagggtttggccgaaacttcaaagccggcgtctggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaatatgaagaaaaccttgcgaacagttgtcgcaaggtttttttcgtttaataacccttttttactttgtggaaaagatcaggatagttggtaaacactcctgttacgccccaatcaagcaggcgatgcatatctgcttcattattgactgtgtaagggtgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcaggtttggctgtaattgatggacttttatcaggctttctttgctgaacgattgaatgatcacctggcctggcttagaatgtttccccagtaatttatgtttctgcaaagaagcgatcagtttttcttccatacctgggtaggtgtcaggcgattttgtttcaatgtagtagttcgcgtgctttccgaaacggtctaatacctcttctaatgtaggaactttaaggccgacgtactgcggctttgctttttccggataggcttcattaaaccaagaaccggcgtcaagcttcttaatgtctgcgagcgtatggtctttcacccagcccgttccgtttgtggtacggtccagtttttcgtcatgcatgacaatcaatttcccgtcttttgtcatttgcagatccaactcaatataatctgctttcattttctgagcggtttcgtaagacagaatcgtgtgctcaggcacatatccagaagcccctctgtgcgcgacggtcaggatacggtcaggtgacagcaggtttccttttgacgctgccgacactggcgttaccataaatgagagtaagcccagcgacagaacaaacaaggccagtattctattttttctcatgatttctcctccttatagataagcactacctgtcgttcatattaaaaaacggatgtaaacggcgtgttggaaaatgattaatcttttatgtgtctttcttaaacatgctctgcccgttttcctgtattccacgtcaaagccaagaagacgatggcaagaatgcaggaagagatcagcatgataaagccgccgttccaattaaagcggtcaacgacaaagcccataatggcgtttgcgaaagcggatccgccgatgtatccgaaaaatccggtcaaaccggctgcagttccggctgcttttttcggtgctagatcaatcgcttgcaggccgatcagcataacaggtccgtagattaagaagccaatgctgatcaaggcgatattgtctacgagcggattgccggccggattcagccagtacaccaatacggcaatgaaaacacccgccataaacaaaacgcctgccggtgcccggcggcttttgaagaatcggtcactgatccagccgcacaagattgttcccggtatgcctgcgtattcgtaaagaaaatacgaccagcgcgagtcttcaggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggtgtatcacgaaccaataaaacaattaaaaatgaaatgataatggcgatgatggcagggaagaaaaacacgcttttccaagtgacgaacatcgcgatcccaagagtgacaagcggagcaagaataccgccgcctatgttatgggcgacattccagatcgacatttttgtgccgcgttcacttatggagaaccaatgggccatcgtcctgccgcatggcggccagcccattccttgaaaccatccgttgataaacataaaaataaacatgatggtgacgctcgaagtcacccaaggcattgaaacgaatagaatattaacgattgctgataaaaataggcctgtcgccagaaaatatctcggattacagcggtcagacaccattcccatgatgaatttgctgaagccgtacgcaatggacacagcggccagcaccaaacccagttctgttttcgaaaatccctgttcctgcagataaggaatggcaaaggcaaagtttttccgcagcaggtagtagcctgcgtagccaatgaaaataccaatgaatacttgcagtctgagccgtttgtatgccgcatccatctttgaatcatccagtctctcaatatgaggagccggtttaaatatattaagcattaataattatccccctttgctgtttgtgctggatgtgtggcgtacctcctttcccaaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttaaggaagtaaatattatccttttactaaatgaaattatatttttttactagtaacataaaaatctggagggaggctgtttaaaggtggatgaattagatatcgcattctttattttaccgttaggaattatgctgctatcgattgtcgggacctgtatttgtaaaaacccgtatctgatgccaatgcttagtttggtgatttctcttgtgctcacctttaccatttttaatgaatcatttttgggatgggctgttgtctatagcttggtttctctggctttatcctatatcacattgattgtggtaaggaaaaggaaggaatcaggaaattaaaaagacctcactttctaacatatcgttgactaaagcaactatatatgattataattgccttagtcaacaatattagaaagtggggattgatttgaaaacaagagaatcatctgtcgggttaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataaactggggcttgaccggggatatgtcagcaggattgtgaagcagtttgaaaaagaagatttgatctataaacagaggagcaaagatgacgctcgccaccattatatttttgtcacagaaacaggaaaaacgatttataaaaagctggaggagaaagccaacgaacaagtagaactgatgctgaaggaaatcaaccaaaaggagcagcacaggcttgccgaggcgatggcagagattgaagcgatcctttcacagtcgctttctgccagaacatcagagatatcgattagagattattttctttcggaggatcttcaactccttattgagaaacaaagacaattttacgcggaggctcacggttgggatgacacgtttttagcttatcttcaggagacatttgacgctgacatcgaaaaaatatggattgcggaaagcggcgggaaatttgctggctctgtcgggttggtcaagcatgatgaaaagacagtccagctcagatggtttctggttgatgcggattttcggggcagggggctcggcacgcaattgctggagcatctggttgcatactgccaagacatgaagtttgaccgcattttcctttggacggtgagcacgatggctgaggctcgtccgctctatgaaaaatttggattcaggataagtgaagtgaaacaagaagcgccattatggggacagcagctgacagaagaacggtgggatttggaactgtcatgaaaagactgcattatgcgtggatcatcgtctccgtcacctttttgatcttattggcagttcagggggtgcggctgtcatttggtgcgtttgtggagccgtgggaacggcagttttcaatggatagaagcaccatctcgctgatttcgacgatgagttttattgtttatggcatatcacagcctgtgattgggcggcttgtggacaaatggggtgctcgggctgttttggcatggagtgcgttactgacaggagtcagcattttcttaacataccttgtgacttcgccttgggagctgtttttgctttacgggctgggtgtctcgcttggagttggcggagcatcgaatgtggcggcaagtgtattggtcgtcaattggttcagcaaaaagcggggactagcctttgggatcatggaagcaggctttggcgcggggcaaatgcttctcgttcccggctcactcatgttgatccattggtttagctggaagctgacggttgtggtgttgggactgctgttaatcttgattgtctttccggctgcgctgctgatgctgcggaacaatccttcagaaaagaatacagagccgataggcggactggctgcatcagaaaaagaaacagcacccaaaacaacagctctttcagtggccgggatgtttcggatgaggcaattctggttcttgatttttccgtttttgatctgtggatttacgaccgtggggttgatggatacccatttgattccgttttctcatgatcatggcttttcaacgacagtcacgagtgctgctgtcagtctgctggcaggctttaatattgctggcatcttgctgtccggaattgtagcggaccggtggagcagccggaaaatcctgtgctttttatatgcggtgcgggcgctgtcgatcgtgattcttatttacagccacgagccctacttgcttttagcctttgcgattctgtttggattagtggactttgcaacggtagcaccgactcaaatgctcgccacccagtactttcaaaactactcgatcggcctcatgattggctggctgtcactcgcccatcagatcggatcggcactaggtgcgtatgtgcccggcgtcatctatacggtaacgggtgagtatacactggctttttatttgtcgattggaatgctcgtgcttgcgagcgtaatgaatgtgatgctgagggagccagctgcggtcacgcgtgacagtgcggctgtggtagacaagtgatgaggacaaagggaaagcatctctgatttcgagattattcagagatgctttttttgtatttttgttctaatacgaagttgatcataccgactatgcgggcgttttcggatttttgtttgaagcgttcagaaatttgaaatttcttgaaaatggggaaacaataaaaacccaaaaaaaggccgatcaaggcaaatacagctaattctattaattcattaaaacgagtgccgaaaaaatagaagtataacgttgttaatgtcacagtacatacgattttggcaagtgtgtttgaatgtaagctgtggttcactaaagaatacctttaattgattcagcatgattaaatcatatttgtttaggaaaataagaagttctttatcatcttttttatgttctaaaataaagttgctgtttctgtttctttatatgtatggtggtccacattcaatatatacatctcttaaagtataaaaattgagtatttcttagtaaggatgaaacaaaactacatgatttttttgttatatctttcagttagaataaaatctataactcctctcattcgcaaatattcggctctctgtgcaaagtgcagaacagtatgtaattgtccttttctagatatatttaaaagctttatcaaatcaataaggattttcaagaaaataattaataatagaaagataaaaatgtgtggtatgtcaatgtaattgatttgtcctgaaaataaagaagttgcatagacaacaataatacttccgcaaaacatcaaactcatataatgtggaagggaaaatggacgagttgaaaaatatgcttttaattggcttagcatagcattatctcttgtatctaagtagcccaaaagctctttatcatttttactaattgtaagaacatgattcaatacagcactaaaattcattgaatcttcattatcagaggcagtatgtttattagcctgtatgttttgttgatccattttatattttttataaagtattgcattaattaacttgtttttctcatagaattcagatcgttgattaagggatgcttttcctttgtttttatttcctttttttatgattttagtataagtcataaaaatacaaatgactgtaaaaatagaaaacactgcaggtgaaatatctgaaagaatagtattggtgaagacttcttttgcttggatgaaaaggaaagaagctaaagtcatagatataaacatgcataaaactgctactttcacaagaaactgaagcggaagagaaggttccgaataatagtgcttcaactggttgagtgtcagagaatctaggcgaaaaagataatctattatctcctgctgattttgcatctgattgatatcatgagcgatgttttttgttttttcaaaaactatttgatcatttttcatttttgataaacctccaaaagacgatagataaactaaaaaaactgcatgagcatattttaacttatgttcatgcagttttgtattaaagttagctagtataataagcaaaaatggccagtaacatagcagataatgcggtagctactttgactcctttattgttcgttaaatcactgcccatattcccaattagtaaaagtgcagcaacacctacaacagggaataaatattgatcataagacggccaatctaacgctaattcactctcgggagacgtaactggtactcccttgtacgtctttattttaaacgtaatcgtagtcgttagtccagttgtgatattgtcaccgactggaatatcaggtgtatagattttaatttgaatatttaaagattcagctgttggatttacataaacctccaaataaccgttgcgtactgataagctcagactatttaaaaggttttgataagagtcgatttgtgacgcagtgagagacgtttgagtgtcgcccaataaacccgtgatataggcacctggtttaccatttgtaatggtaattgtgtttggtgaaccttcacttggtatggttgccagaagtgaagttgatagaataatatccaactcaggtgatgtgaaaatggtttctgtcgtatcaaattcaaacatcgcatttgccagacttgttagattttctaaagccggaatggtagataaaatgtctgtcagtgtacgcagccttgcatcatataccggatcagacggcggatttacattgcttgcacctgagtctcttcctgaaaatccgtctttatcaatcccgatgcttccagaaccgcttccgatggttccttcataaaattgatcaaaggcccagttgtttggcatcggatagccgagattgccgctaaatcctgttgacatatttgccacaaaactatactttgtcagtcctgcttcagatgtacggatacaaatgtttcttggtccgtaaacccctatttcatacttaggtgcggttgaaaatgtctgcatttttgtaaatgctgacttaatctcttggaaataaggaatgattttatcggtcacttcataatcgtatgcatcaaaatcgacagcgaaataaatggtcgtgcctgacggaaaacctaatcttctagcagcagaagcggcactatatgcatctcttgtgccttggtctttgacaaaataagaagattcatagccgccgtcttgataaattgggaaaaccttcaatccggcatcaagaataactgcaagctctttagatgtcagggctttagatgtgaggccgctgcttgtccgcacatttccggtcaaatatctgccaaccgttttataaccgttattccgcagtgtttgagctttttctgcggttataattgtagcagtgtcacaagcagaagcggcgcgagttgtgtctcctgagcttgataataaagctttaatggttggcatatctgcataacctgtttgcggcaggcacatgaactcttgaaatgctttaacagctgaaacaacacccacaccatatttgccgtcaaactcaccaggatcgaacgattttccgttacaatagagggcgtactgaacaattaagacaaatcctgttcttgaatcgccgggagttaaagtagggcataaacttgtggtgccgtttccgaaaaatccattggcaacacttgtgctcatgccttcttctttttgtagggcataaataagagctttatttgtatcgcggccatacagtccgtcacaaggcattaacccgatatagtcattgtagtcccgatttaagttttgttgaatctggcgaattcttgaatcacccccagacaccagcttaaaagcgctcatgtctaataaggctttcataattaacgtggtgacaatcccatcctgtgttgtcagtccggcagctttttgaaattcttttaccgcattttctgttttttcgtaaaagacgcctgtaaaaccgccgggattaaagcctttacaccataaagccccttgtaaaataaaattcatgttgcttggttttgaatctggagcttggcgtttaagaggcttaaataagcgctgtgttgtcggcccgaagttatcggctggctctgagatacccaattcaatttgaagcgcccgagtcagaccgtagatcgtatcccacccagttttcccgctttcttcaactgggttatacccatgtttgccgctgtacgtatcgttcagccattgctgtgtgattaagaccatttcatcaaccatttctattcctcctttgttagattgcgttcatttataggtggcaaacgtaggacaaaataaaaaaatagatgccgttaagcatccattttacatccgttctccatcagcttcgctttcggtttcatctccgagatgtagaggcctaaaagcgtaagggcgcctcctagaagagcgatccatgtcatgttttcatgcaggaccaggacggaagcggcgattgtgataaccgggaccatgtatatatacgcactggatttgacggctccgagcacgccaactgaataattccaagtggcgaagcacagggcagaagcgccaatccctaagaaaagcatgttgagtatatttgaagcagatgaaaatcggcttaggtccaaatggaagtcgaacaaaaataaagcgggaaccataaataataggccatacaaaaatactctctgtgtcagctcgatgatgtggtattcgtaagcgcttaattttttcatgaatatcgagtatccgccaaacacgagagcagccccggctgccatgatgtctccgagcggatttagacgcagtaccacattgccgttaaacgtaatcaataaaagcccgatcagtgccgagacaaatccaatcaaaaaagtcagacgcagtttttcgccttcgagcagaaaatgggccaaaaccgcagtgatcatcggtataatggacacgatcatgccgacattggaggcgtatgtataggtgagagctatattttctaatagaaagtataaggttacgccaaataaaccagccccggcaaacaacagctcctgccgccaatttctgaacggaatcatgttgggacggacgaggataagagcgataaagcccatcaaaaaccgataaaataatatttccattggagagaagtcagccagcagaacttttgtcgaaataaaggtcgtcccccaaatcagaatggtcacaatggctgcgatatgccccgaagtttctctttgtatgttcatctgtgaagctccttttcaaaaatcttcatgtattgcttcggcgtcagccccacctgccgtttaaaaaacttcgtcatatggctctgatcgctgaatcctgtctgaaatgccgcatcaatcggtcttaccccttgttcaaggagttttttggcttgattaatccggattgtttccatgtagctattaggggtaatgcctttttgttttgtaaatgaacgcaataaatgatacttgctccagcctgttaattcactcaaatcattgagtgtgacattttcggcataatgctcttctaaaaattcacaaaccattttgacttcgtctgatggttctggaacgctgctaaggaacgtgacatctgaataatggcggatcagctcttctaatagatgaagaaacagctcctccttacgcaaagcttgtttttcctcggatatcaaaatatgcaattcctgcaggctggctgtcagctcatggcggaataacacatgctgggagaaataagggagatgcccggagccagtaatctctttcaccgccttctccatgatatccggcatgacattgatacaccgataatcaagcgtccggccgtcaatctgttcacagctatgcgtgtcacgggggttaaagaggagaagatcacctggattgatgatatattcttgatcctgacaggccagataccgttgccctttttcaataaatccaatcacataataatcgtgaaagtggttcggaaacttttgcataattcccttgaaacggtaggcttctatatgaaggtgtgggtcaagctgcaatgtgcgggtttcgttttgcatgggatgcctcctgtcggtgtggtggtcttggattaagtgtagcatgattttgggggatttcttgtatgatgttgctgtttaggaatagagaaagcagaccgttattggtctgctttcttttccatcagtcatgaataggatttgtggtgcccatatcaactaatgtaaacgtatacatattgtgtgctaataggcgggcatctggatttttccaactcaacagggctttaaaatctatgctgactttctatgtgaacgaattctgtcagcgggtagaagaaaacaggaggtcaaaaatatactctgatttcacctacgttcgttataacttagtattttaaaattaaacatctggtaaagaagtatatcgacacaaattttcaagaaggtttatatgatgaatgattcaaacttgttgtgaacgtattatgccacgtagggcattatattagttgttcaccacatttaccgctaacaccagccataggcaatccgattaaatcctttagaaaatcagcaggtcaattgggccctctgccctttttatataaaatcactaccgcgttgtagacataatgtcattaagcgcccgtggttctaatacctagccttacctgtgctgacagggataaattttgtcaccttatcaatagtccatgagatcacttgtgtcagcaattttaatcaattcgggcaattgacttctagaaaaagcatatattcatgattcaaccacatagaaagagaggaactggaaaagttccgatgtttgattactgtttttcctcttcaaaggtttgtcgaaagtccggataaccgagttttagttttcatagagagtgacgtaggctttgagacgcactatctataaaaagtcctaatggaatagattatgtatcaaacaagcctttaaggctatgtctataccctttaggtcttttatttacaaaaaaataaacttttggattatttttagagttttcagccagaataaggttacaaatattagagatgaaagaattttttacaattaaaataggtatatagggataaatctaaaaacaaatgaaaggatgaaagtaggtttcttttaacaaaaattccttgttttttatatcgaatgtttttgaggacaattaattaaaatatggaacacaagttcgattttttctaggaaaagaaaggtgattgcatatgtatacacttcaagaaattagtaaacctaaaagaaaaaaactagtgaaaaatattgagaagcacttaaagaactacaataattacaaagttgccatccttaatctaagtaaacagcttgaattcatagctacaaatgataatatggaaatctttaaagaaagcatcgatgatgactgtgagtttcaggaatcagtggataaacttgccagtgagttgcaacatatcaaacttctaaaagattcaatcgatatttcattatcagaattaacagaactagagtacagatttgttcaataccgttatttcaaaaattggaccatcgaaaaaagtgcactagagatcggttatagtgataaagcactgtttgtaatacgtaatcaggtaatggataaattattgatcagcttagggagcgttgtttacatgtaaaactttatagagctgtataaaagcagattggtacataaaatctttaaagttgaagatagaagtataactaaatcaaaatacttctacctttttctttaaagttatcaattattatacttttaaaaagatagctcttaactgatagcaatagattttaaaaataaaggagatttgatgatggataaagggacatttgttagaacgttcgtcttgatcatagcacttataaaccaactactcacaatatataacaaatcacctcttcctttagacaatgaacaattggaacaattcgtatctatggtattcacctctgtagcagcaataatagcatggtataaaaacaattatgttacaaaaaaagggcactcacaaaaacaattattgaaggagaagaatttaattaaagtcaaaaaataataatcataagacctgtagctctcctaaataggggagctttttatttatatacgtagaatgagatacataaaatataaaattactttgcactcaatgataggcgcatcatctttgactgagcttactaagggagtaagtctattatctatctagagataggaaatttataaaatgaatgagacagggaattaaaagtcaattatagccctaaaaagctggtcatactgcttttttaacctgtgcctaagaacctaaggttgaatactttttaggttcttttttttatttttatgggatttttagcttacttaatgagtactcttaaacctcattctagatttaagataattatgtactcttcctcatggggattaaaaaaaaaatggaggtttattatggcaacaacatattctacaactacttatactgttaaatctggagacaatttaggaagtatcgctcaacgatttggaatgacattgtcagagatccaatcactgaataacattagcaacccagataaaattcaagtcggtcaagtattgaaagtttacgctagtggcaatgattctggcagtgggggttccacacgaaaaacgaccacttatactgttaaatctggagacaatttaggaagtatcgctcaacgatttggaatgacgttgtcagagatccaatcactgaataacattagcaacccagataaaattcaagtcggccaagtattgaaagtttacgctagtggcaatgattctggcagtgggggttccacacgaaaaacgaccacttatactgttaaatctggagacaatttaggaagtatcgctcaacgatttggaatgacattgtcagagatccaatcactgaataacattagcaacccagataaaattcaagtcggccaagtattgaaagtttacgctagtggcaatgattctggcagtgatggttccacacgaaaaacgaccacttatactgttaaatctggagacaatttaggaagtatcgcccaacgatttggaatgacattgtcagagatccaatcactgaataacattagcaacccagataaaattcaagtcggccaagtattgaaagtttacgctagtggcaatgattctggcagtgatggttccacacgaaaaacgaccacttatactgttaaatctggagacaatttaggaagtatcgctcaacgatttggaatgacattgtcagagatccaatcactaaataacattagcaacccagataaaattcaagtcggccaagtattgaaagtttatgataatggtagtaacgatgatacaaaagatgacaactcgactccagataaaggagatggtggttcatctgtaacttatgtaaccgagagtcagttaaatcaaattggatggtcaagctcttatatttcaaaagctatgttgcaagatttgaataattgtttagaaagatacaacattacaactagatctagactttgtcattttattagtcaatgtagtcatgaatccggagctggacgatggagaaaagaattagcatcagggagagcgtacgagggacgcgcagatctaggcaatactcaaccaggtgatggtccaaaatttaaaggagcaggttatattcaattaacaggtcgttataactacacacgtttttccaacgcaattggtgattctaaaattataagtctaggtgttgattatgtagctaataattatccatggactagtgcgggattttggtggcattcaaacaatatgaatgcactatgtgacactaatccatcagttgaggcagtaacacgaagggtcaatggcggttataatggattagaagatcgtagaatgtattataatagatgtattaaagtattctaattgatagtggaaatagtatatatcagaggggcggttcaatgtattgatgaactgccccttctattgaaaaatgtttggtattttcgtttcaataattagcgatgaatgattaatgaataaccattatatcaatgagtcgcttaattttcttatcgtcgcctgtatcaacgtacactttttttgtatttttcttaatgtcctcagtctctttcttcattatccctttatctaaattatcagcggagtcccagcgtaaaggaacattgtatacattaatcgtgccattcccattgccgctgtaagttactgatccatccactaaccgagaacctgccaactggatcacatcttctggatagctggcactggagtcatcattaggattgatcggttcgccggctgaaatatggcgaacattcaattcgtctatatcttgatttggcccaagctgcagccaaactcgggcatattcgattttatcggatgaatattctcccagtacattgtcattttcgcctttcccctcatttctttcttctattgaagatgtttcttttgaatgatcatccgttgcagaaccttttgaggaattttcctctgaatcctttgttgcagaaccttttgaggaattttcctctgaatcctttgttgcagaatcttttgaggaattttcctttgaatcttttgttgcagaatcttttgaggaattttcctctgaatcctttgttgcagattcttttgaatttggctccgattcttccttgcctatttgattgctatctttagtctcatcgttattttcttcagaatgtaaagcagaatcattatctgaaggattttttgattcttctttcttattgcccgaacatgcagcaagcaataacacgagcagtagcagggcaacattacaataaaatagctttctaagtttcttcattattttattcctctccttcaatcaacaacataccatacagggaaaatatgtcaagattctatgaaccttaaagagtgtactttgaagttcaactctaggacgattattaatactaatacttagattgattcctctaagatcgcccaaagtaacagtaaattgctgagtttgttggcttcaatggcctctgtctggtacaccctgtggcatttcgctagaactccctattagtatggtaacatggtgaatttaggaaaggagcgaaaactgaaaaaatacaaaaaaacggttcttttttactgattctttttaattattttactcatgggcaggagaagctgctgaagtcagcttcggcgtgaattctcgtcagcttcttgtaccagttctatgttttttcgcgttttgccagactaaatgcattagctaagttcattaatgtttcggttgggtttgcgggattgattgatgacgctatttgttccgtgcttcctgttagtcggcttgctttcaaggagagacagggctggctccggtttggaatgagaaacttggctgtttcatttattcgtgctttttaatgccggcgcgaattatttgggtgtgtatcttcatttagttttcccattcatgcatgacgttaaatcaatgctgggtcggttggttaataaaggagatgatatcaagtgcgtgagaaagattcaaaatgtcgacatcatattgtccaaatgtgtttagagaattgttagcctgaattggcgcatcgcttgtcagattagctgcgcagttctgccagtagacggcgtttttctttttgatagttaatttggaggtgcaagaagcggaaaggaactggtaatgattggaacaagacttcggggctggcattttgcaggagtggatatgtcagagtgaatgctagatgagtgtgaaaaaaatgatgtgctggagaatcaagcggctttgatagaagaagatatcactcaacatttatttgatagtgtgttttcgcgtgcgacatgtatgcttgtgctgcattttttgcatgactctgaatgtcaaacgggaatttttgagatgtataacacatcagctggaaaacggagatcttctgtgctggcttccatttatggggagtccatttgttttcgttttaatggcagagggaaagtaagatcttcttattttggtttctttaataaaaatttatttttcaaatatttcagttataatggtttggaacagataggaggggcaaagatgtatcaatcaaagaaggttttattgttaggttcaggtgaattaggtaaagaggtagtgattgaagcccagcgtcttggggtacagacggtggcagttgacagttacgagcatgctccggcgatgcaggtcgcgcataacagttatgtcgttgatatgctggacccagagcagatcagaaccattattgagaaagaaaagccggatttgattgtgcctgaggtggaggcgatcgcgacggatgaattgctgaagcttgaagaggaaggatttcacgtcatcccgaatgcccgtgcggccaagctgacgatggatcgggaaggcatcagacggcttgcggcggaaacgcttggacttgcgacggctggctatgaatttgcgaatacatatgatgaatttatacaagcggcagcacagatcggttttccttgtgtcgttaaaccattgatgagttcttctggaaaaggccaaagcatctgccgctctgaagcggatttagagagctgctgggagacggcgatggaaggcggacgggtgaaaaacggccgcgtgatcgttgaggagtttatcccattcgaatcagaaatcacactcttaaccgtacgtgcggttaacggtacggcattttgcgagccgatcggtcatgtgcaaaaggacggggattatatcgaatcatggcagccgcatgatatgacagagcagcaaatagaagaagcgaagcatattgcgaaaacgatcacggatgagcttggcggatacggtctgtttggtgttgagctgttccttgcgaaagatagggtatatttcagtgaggtatctccccgtccgcatgatacgggtcttgtcacgctggtgacgcaaaatttgtcagaatttgcgctgcatgtccgggcgattctcggctttccgattacagaaatcacacagctttctcctggcgccagcaggcccctcaaagcgccggaagaattaacggattacactgttgaaggattggaaaacgcactggcagtcccaaagactcaaatgcgcgtctttggaaagccgataacgaaagccggacgtcgtatggcagttgcgctctctgctgctgattcagttgaaacggcaagagagaatgcaaagaaagcgttggaacagctaacgataaaatagagtttgagcaggtcttgtcatggtacaaggcctgtttttttctttctccgtaaaagttttatcataagaatcagaaacccgattataatgtaaaagtcttccatcaatacgggtggttgacactaaaggagggagatgacaaaatgaaattagttccaagattcagaaaacaatggttcgcttacttaacggttttgtgtttggctttggcagcagcggtatcttttggcgtaccggcaaaagcggcagagaacccgcaaacttctgtatcgaatactggtaaagaagctgatgctacgaaaaaccaaacgtcaaaagcagaacaggtttccgccccttatgagggaaccggaaaaacaagtaaaccgttatacggcggccaaacggaactggagaaaaatattaaaaccttacagccttcgagcattatcggaactgatgaacgcaccagaatctccagcacgacatcttttccatatagagcaactgttcaactgtcaatcaagtatcccaacacttcaagcacttatggatgtaccggatttttagtcaatccaaatacagtcgtcacagctggacattgtgtgtacagccaggatcatggatgggcttcgacgataaccgccgcgccgggccgcaatggttcgtcatacccgtacggtacttattcaggcacgatgttttactccgtcaaaggatggacggaaagcaaagacaccaattatgattacggagctattaaattaaacggttctcctggaaacacggttggctggtacggctaccggactacaaacagcagcagtcccgtgggcctttcctcgtcagtgacaggattcccgtgtgacaaaacctttggcacgatgtggtctgatacaaagccgattcgctccgctgaaacgtataagctgacctatacaaccgatacgtacggctgccaaagcggctcgcctgtttatcgaaactacagtgatacagggcagacagctattgccattcacacgaacggaggatcgtcatataacttgggaacaagggtgacgaacgatgtattcaacaatattcaatattgggcaaatcaataaatacagcaaactagccatattcatgtctattttgtttttatgcgggtgcagttcgcagacgcattcttctccaaaagaaacgactattcctgttactcttcatgtggaggatgctaaggggctgccggtcgaaggggttcaagtgacgattgtcaaagcgcctgcctcagacgaggagccgagtacagagattggcgagatactcggtaaaacagacaaaaacggagatatcaaatgggataccggcagaaaaggagattactcagtcgcgttgacgaagggtgaaacatcagtaacccatcacatctcgttaacagaggaaaaaaaagatcatgccattccattagtcttcaaagaatagcagtttccttgattttaagggaactgccttttttatttattgcaggaaaccaaactatatactggaaatttattatgtgagataataagaaataggtattttttcttacgagacaaaaggggcgttatcctttattttatattaatcaaacccggaggaaaaagaagaagatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacggaggccttttcagctctgcgatgtggtatccgaatatcgcagcgtggagcagtcaatttcgtacatatgcggtcgatataataggagacaaaaataaaagtataccatcagcagccatggaaacgagagctgattttgcagaatggatgaaagatgtctttgattctcttggacttgagacggcacacctggccggtctttcgcttggcgggtcccatatcgtgaatttcttactctgcgcgcctgaaagagtagagcgggcggttgttatgagtcccgctgaagcgtttatttcatttcatccggatgtctataaatacgctgcagagcttacaggggcaagaggagctgaatcatatatcaagtggatcacaggcgacagttatgatctgcatcctttactgcaaagacaaattgtggcgggcgtggaatggcaggatgaacaaaggagcctgaagccgacagaaaacggctttccgtacgtgttcacagaccaggaattgaaatcgatacaagtcccggtactgctgatgttcggtgagcacgaggtcatgtaccatcagcaaatggcctttgagcgggcttcggtattggtgccgggaattcaggctgaaatcgtaaagaacgccggacatctgttatctctggagcagccagagtacgtcaatcaacgcgtcttgtcctttttatgcggggggataaactagtaaggaacatgaaaagattggcattcatttttcaaaaggtaacaaatgttgtataataatagaatttgaatgctgctttttttgggagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggagagaactggattcgtttgccgatctggttacgtttggggtggctcctgctatgcttgcttacagtgtcgcgttgtataccctgccatttatcgggatcttatgcgcattgacgtacagcatttgcggaatgcttcgcctctctaaatttaacattgaacaaagcaagctcccgacgtttatcggtatgccgattccgtttgcgggcatgtgtctcgttattttaagctttacctataacccgatccttctggcaatcggcacttgcggactttcatatttgatggtgagtaaaataaaattccctcattttaaaaaacatgcggcagaaaacctggagtctgggagatggaattagttcagcagctcatagcggattacggttatctcgctatttttttgatgctggtattaggaattgtaggattgccgattccagatgaagtgatgatgaccgttgttggctatttcacgcataccgatgtattgaattatgagctttcgatattgattagttttgtcggggctttgttaggtatgctgatcagctacatgattggcagaaaagccggacgcccgtttatcgacaagtacggcaagtgggtcggcttaaaagaaaaaagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgcggcaatcggcgcctttttatggtgctttgtttttattacaatcggaagggttatagggattattcatgtttaatacggctgtaaagattctgtatcgatcattgatagagctgacgaatcatcgtctgtcatcctatctgattaaaggattttgcgagtcaaaaatcagcaaaccggtcattccgcttttctcaaaacattttcggctgaattgggatgatgtggacggtacggctgctgattacggatcgctgtccgaattgtttattcgacaaataaatctggagcggcgccctgtgtcaaaagaggcgcatgcggtggtcagccctgttgacggtgtggttcagacggtaggaatcatcaacccgaatcaaacctttacggtgaagggaaaagattactcattcgctgaactcaccggctgtaaaagcgcagaccatcaatacaacggcggatacttcgtcgtgctgtatctaagcccgaggcattatcaccgtttccattctccgatcagctgcaggtatcaaaagctggccgagctcggaaatcgctcatacccggtaaatcaactaggcttaaaatacgggaaagatgtgctgtcgaaaaattatcggtttgtgtacgagctgaatagcggcagccgaaatgtcctgatgattcctgtcggcgcgatgaatattaattctatcgtgcagacgagcacccgtgctgaattggagatcggcgaagagctgggatacttttcattcgggtcaaccgtcattttgatttttgaaaaagacgcgttccagccgtccgcccatttagcagaaggccaagaagttcaagtcggagaactgataggttatgaagagtaagaagaggagcttgcataaacgcagcgcctctttttttgaagaaaggtgagattcatggagaaacaaatcatcagctggattacagattatcagaacaccggagatgaagccgtcctgcggcaagtgcgagaagtgtgctggccgatcgttgaagcggttttgcaagagaaggcaatagatgatgaacaagcgaacaatttgcgcgaaaaaggaatcgagcggtttccattcatcatcagcaaataccaagcggatgtgcagcttccggttgagacatttttacgaaatacgtatcggttttactttcatcaggtgatgagagaatccagctaaagcttctttcaacagagaagctttttttgttggcaggaaaaggaaactttttctatatctatctcgtaatgactagagaacctagcagaaaaggagagatagaattgaaacgaatgatagtgagaatgaccctgccgctgctgatcgtttgtctggcgttttcttctttttcagcctctgcccgtgctgcttctgaagaaaaatattggggttcatggattgaacgacatgcacagccgcttgatgcttccaatgcttcaaacaaagaccttcgctttctgaagaaggtgctgaagggaaaacgaatcgttcagttaggagaaaccacacacggcgctggtgaaatcaacgccacaaaggtcagaatgatcaaatatctccacgaagagctgggatacgatgtattggcatttgagtctggctttcctgatacaaatgcatcctaccttaatatggaccaattaacccctaaaagcacgatgaaaaactccatttacgctgtatggcacacagaagatgtcgttgaattgtttgattacatgaaagagcaaaaagagaaaggcgatccgctgatccttaccggttttgatattcaaagcatgaagaattcattcaatgatgctgcgactcaatgggtaaaagcggtgaaccctgagaaagcagagttgctctcccaatcagaaaataatttttcaacattagtgacagacagcaatacgtttgatgaattttcgcaaaagaaggaaaagcttgtgaaaaactatcagaagctgatcaagttcgctgaaacacatgcttcagagctaaaagaaaaccttccaaaagagccgaaagcttatgagatgtttatgcattctcttcagctgagaattgacgtaatggaaacgtatatgctggaagaaatgaaagaaaaactagaggagtatccggagaatattgaggatttttcattctttatgagagaccgcatgatggctgagcaatttcagtgggtagctgacaccctttatccgaaaaagaaaatcattgtctggggccacaattaccatctgcgcaaacagaatacgaagatgataaaggactgggtacagctaaacggccctaacatgggtgattatttgccggagcggctgaaaaaacaaacatatacgattggcatttatgcttactcaggtgcaagtctggatagttctgataataagacggttatgccggttacaagcccgccgccgtctggaagtcttgaagctttgctgaaagctgcggatcatccagttgtttttgttgattttctccatacaaaaaacaagaaaggcacttcgtggatgtataccccgcggactgcgctctattgggggtacatggaagagcagatgatccttaaggaacaatatgacggtgtcatttggctggagcatatcacgccgtcagtcattatcaagtgagcggtgtcccctgtgctataacaggtggagttcaccttttgtttgatagttttcagataactacatttattagtaaatgaatggaaaatacttgtgtgccgtgagaaacccttgtgccgcttaggtttgtaagagattggatatttttatcagtctgggcggatctgttcatctttgcggcattttcctgtatgatatagtaagagtgtgcatagcaactaactataattgaacagggtgtttaaaacatggaaaaacaatacagagtattactttactataaatatgttccgattgaagatccagaggcgtttagagagcagcatctggctttttgtaaggagcttggtttgttaggccgtatccttgtttcttctgaaggaattaacggtacggtatcaggtacggttgaacagactgaaaaatatatggaaacaatgaaagctgatcctcgttttgcggacatggtatttaaaattgatgaagcagaaggccatgccttcaaaaaaatcttcgtccgccataaaaaagagcttgtaacgcttcgtcttgaagatgatgtcgatccgaatgaaacaacaggccagcatttgaagcctgcagaattttatgagaagatgcaggatccaaacacaattgtcatcgacgcgcgtaacgattacgagtatgaccttggccatttcagaggtgcggtccgccctgacatcgaagccttccgcgaattacctgaatggattgaagaacacaaagatatgtttgaaggcaaaaagattttaacgtactgtacaggcggcgtacgctgtgaaaagttctcaggatggctggtgaagcaaggctttgaagatgtagcacagcttgacggcggaatcgtgacatacggaaaagatcctgaagtgcaaggcaagctttgggacggccagtgctacgtatttgatgaaagaatcagcgtgcctgtcaaccgtgtcgagcatgtgattgtcggcaaggactactttacaggagaaccgtgtgagcgttatgtgaactgtgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcacgctgctgctgaataataaaaagaacacctcggattgaggtgttcttttttctatatgctttcagtttggctgtttgcggaaacccattctttttggcggaaggccttttcccattttgataccacgatacaggcgatcgcatgtcccggtacgttcacgcctgttctcgccatgtccatgacgcggtcaacacccgcgataatggcaacgccttcagccggcagtcctacagcattggcagtcgccagaagaactacaagcgatcctgagggtacagctgcaatgcctttactggtcatcacaagcacaagcatcatgagcagctgctgggacaatgtcatgtctacttgaaaggcctgtgcgagaaagatacaagaaaccgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccatattggcccacagaagctgccatcagggctaacacgccgataggagcagtgaccatgacgatttgtgtgagcttgaacataatctgagctgtagattcaaaaaacttcattactggttcagaagctttgccgataccagctgcggcgacaccaaataaaatggcgaagaaaataacggcaagcaaatcatttctggccatgacatcaataatgtttgtagggataatatccaggatcatttgcttgaaatcaacaactttgtctgtgtagccggaaagttcatgaatatctttttttgccaaatgggagaggtcaagcccgacacctggttttaagacattcgctaataaaagtccaagccctaataccaacgttgtaatcacttcgaaccaaatgatcgtcttgatgccgagactgcccatttttttcatgcttccgcttcctgcggctccaatgacaatggtagaaaatacaatcggcacaacaatcattttaatcaggcggataaatccatctccgacaggcctcagtgccatcccgaaatcaggaaaaaagtggccgatcaccgcgccgacagccaaagcgattaaaatttgaaacgcgattaattttttcaaatgaatccccctttagaacgatagaatgtaggcatattcatatcattcgtgattcaaatgcaaacaccttttttcaagttattttattttgacagcgctttcattatgttggcaaaaaagtcccccgcagcaggggggacttttttacttcatttgaatgtgctttagatcttcttcagaagtatttgtgaaaataaccggtgttatggctgaagcggcatgctgcttgatgtaattgagatcaaaggtgagaagcagttcgccttgtttgacggcttgtccgcttgtgacatgtgcttcaaagccttccccatttagtttgacggtatcaacgccgacatgaatcagaatttcagtgccgccggcgctcataaagccgatggcgtgttttgtcggaaaaatcgagacgatctcgccgtccgcaggtgcaacgacttttccttctgatggtataatcgcaaatccctcgcccatcattttttctgaaaagacttgatcaggcacatcccctaaagagactgtttctcctttaatcggataaataaaggtctcatcggaatcgggcttcagcggtttgtcagttaccgtgtccagcgcggcggcggtggcagggacgcctccggccatgattgttttgatgtcgtcttttaaggcatcggacttggttccgaatattgcctggaagttgttgttgacctccagcacacctactgcaccaagccgttttaattcatccttgctgacttggcttggctgatgaacggttacacgaagcctagtgatacacgcatccaggttagcgatattttgctgtccgcccaaggcctgcagcacgtgaaaggcaagctggtcttttgcaactggagctttctcctcattctgaccgtcttcatctgtctcacggccgggcgttttcaaattccatttcagaatcgcaaatcggaacaaataataataaatgaaagcaaacacgatcccgacaggaatgacaacccagccgtttgtagacagtccgtagttcaagacgtagtcaattcccccgcctgagaacgtatagccgtggcggacatggaataaatcacaaacgacaaagatgacgccggcaagaatagagttaatcaaatagagcacgggcgcaacgaacaagaaagaaaactcaaccggttctgtaattccggtcagcatagatgtgagcgccgcagaaatcatcacgccggagatcatttttttcttttccggacgcgcggtatggataatggcaagagcaacggccggcagacagaaaatcatgtaagggaaatcccccatcataaagcgcccggctgtcgggtctcccgcgaaaaaccttgtcaggtcgccggttacggtgttgcctgttgatgggtctgtgtattctcccatcataaaatagaaaggcgtataaaaaatatgatgcaggccaaaaggaatcagcaaacgatagatcgttgcataaaagaacagtccgactgttgaatcggcaattaaactgctggctgcgttaattccgttttggatcagcggccaaacgaatgagaaaatgacaccgatcaccaatgaactgacggaagtaataatcgggacaaagcgttttccagagaaaaatccaaggaccggatgcagctcgattgatgaaaaccgcttatataaataggcggcgagaagcccgataatgattcctccgaaaacccccatatcaatcaggtgctcggctccttcatacggaggctgaaggccgagtaattttcccatattgtcgagggtgacggttaaaattaagtatccgatgacagcggcaagtccggctacaccttctccgccggctaatccgatcgcgacccctacggcgaaaatcagcgggagattatcgaatacaacgccgcctgcatcctttataatagggatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgttttatgagcatggagcactctttaatttttgagctgctttataatcggcgataacggttacatgattgtgtttttgaagaatggaggctggtacttctgtcgtgacaggaccttcagccatcttttgaatagcgtctgctttttcctcgccgcttgctaaaagcacaatatgtttgctgaattccatgatggttttaatgcccattgaaatcgcgagtctcggcaccagcaccggatcgccgccgaagaatctggcatttgcctgtatcgtgctttccgagagcttcacaacacgtgtccggtcttcaaaatcagatcccggttcattaaaaccgatatggccattggcgccgatgccgagaatttggacatcaatgcctcccgcctggcggatgagatcctcgtatactttgcattccgcctcaagctgcgggttgtctccttgcgggatatgaatatgatcaggctgcatattgatatgctgaaaaagatgctcatgcataaaatggttataactttgcggatgagatggagagagaccagcgtattcatccaaattaaatgtagtaacctttgaaaaatcaatttcgcctgcctgatagtctgaaatcaactgcttatacaagccgaccggtgtgcttcctgttgccaggccgagaacggcatctctcttagcttgtatttgttctttaataatggcagcgcttaacttacagagttcttcgtagtgctcggcgatcagaatcttcatgtgacaccccctcaaagagatagacaagcaccttatttgttatgaccaatttatgatacttgtcattacgaatttagcaccgcccttatcaaactgtcaatattaatttctgaaaatttgttataaaagaaggatacaaatctttcatattgggatggcaaatggtattatggtctcaattaaaaagaacggaatgcatacagaatggggagaatgaaatgacagctttatattctgttatcaagtttaaaatcattgagttaattaaatcgggcaaatatcaggcgaatgatcagctgccgacggagagtgagttttgcgaacaatatgatgtcagcagaacaactgtgagactggctctgcagcagctagagcttgagggatatattaaaagaattcaaggaaaagggacatttgtatcggcggcaaaaatacaaacgccgattccacataagattacgagctttgcagaacaaatgagaggccttcgttctgaatcaaaagtgcttgagcttgtggtgattcctgccgatcactccattgccgagcttttgaaaatgaaagagaatgaacctgtcaacaagcttgtcagagtcagatacgccgagggggaacctttgcagtatcatacctcatatattccctggaaggcggcaccggggctggcgcaggaggaatgcaccggctcgctgtttgaattgttaaggacaaaatacaatattgaaatcagcaggggcacggaatcgatcgaaccgattttaacggatgaaacgatcagcggccacttattaaccaatgtcggagcgcctgcgtttttatcagaatcccttacctatgataaaaatgaagaagtggtggaatatgcgcaaattattacccggggagaccgaacgaaattcaccgtagaacagtcatatcattcataaagcaatgtgttttaagaagggaatggtggttctatgtttttatttacgaatggaaaagtgctgtggggagcagtgattgctgcattcatcctttcaattgtattttacccttttctgccgacgcagatgccgattcattatgatgttgcgaacagtccggatctgacggttaacaagctggcggggactgtgatgctgcctattttgatggtggtgtttgcatgggcggggaagatcaattggcaatttgtattcgcagtgtatattttgctgatttgccacattgtcgtcctttgtttagcgctctaaatcaaacagccagaataaaactggctgtttttctttaatttcagcttcatctgacaatgaatgtggtgtataatagctgatgatcctaaagaatattctgaaatttatcggtgtggagcggcgtatcatgaaaggaagggctgtatgttttttgcagccttaaaaagactgaatatttaaacaattatgtgaaaggtgtgctgattagattgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaaggattaaaagcatacagaacagacgacggcagggtgctgctgttccgtccggatcaaaatatcaaacggctgaacagatcgtgtgagcgcatgagcatgccccctttagacgaagagctggtgcttgaggcattgacgcaattagttgagctggagaaagattgggttccaaaggaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgtcgaagatgagtatgtgcgggcggtcaacggcggagtcggatttgcaaaaacggctggaaactatgccgccagtcttcaggcacagcggaaagcgaatgagctgggctatgaccaggtgttgtggctggacgccattgaaaagaaatatgtggaagaagtagggagcatgaacatctttttcgtcataaacggggaagctgtcacacctgctttaagcggaagcattttaagcggggttacacgtgcgtctgcgattgaactgattcgaagctggggcattccggttcgtgaagagagaatatcgattgatgaggtgtatgcggcctctgcacgcggagaattgacagaggtcttcggcacaggcacggcagccgtcgttacgcctgtcggtgaactcaatattcatggaaaaacggtgattgtaggcgacgggcaaatcggggacctctcgaaaaagctgtatgaaacgataacaaatattcagcttggcaaggtgaagggcccgtttaactggacagtggaagtgtgaaaactgaaaaagaacctgcccgaaggcaggttctttttattttgaatgagtcatatcagcagccggctggcttttgcggttttttacataatatattgcatagcaaatggccataaatggaacgccgcaatagagagcgattctttgattcggatcaaaggcaatgccaacgacggaagccaggcataacaggaacgcggcaatcggcacgaacggatagaaaggggttctgtatttcaaatcagtaaccttgtttcccgcttcgatataacgttttctgaacatgaattgagaagcagcgatacccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccgactctgtcaaagacagcgacaaacgggcttttgataacacctgcatcttgaatcggaatcagccctgacagcacaaaaattgttccgacaaagaagagtgagagacgccagaccgttgtttttatcgcttttggtattgtcttgtcaggatcaacgctttcaccggctgcgattccgattagttccgttcccgaaaaggcaaaattaacggacagcatcgtcatcaaaatcgggacaaatccatttggaaaaaacccgccttccgccatgaagttggacagcatcggagcggcttctccgcctttgatcgggatgatgccgaacatggcagagccgcctaaaagaataaataatacaatggctaatactttgatgctggaaaaccaaaattctgattcagcgaaaaacttgaccgaaaatgcgttaagcaagaaaatgaacagcgcaaagacggcactccacatccaaaccgatgtatgggggaaccagcgctgcattaacaggccggctgctgtgaattctgatcccaatgccacggtccatgtcagccagtacagccaagcgaccgtaaatccggtgcccggccctatgtatttagctgcataggtgtgaaaggcgccggtcacaggcatggcgactgacagctcaccgaggcatagcatgaccagatagacgatgccggccccgactaagtaggcgagtatcgttccggccgggcctgcttgctgaatggtataacctgagcttaaaaacagcccggttccgatgacacctcccaaggaaagcataaagaggtgccggcttttcatacttctctgaaaggttgtctcattcttgttgtgggcagagttcatctttttccaactttctatcagcgatttatttcctcctaataaaaaatctcatgtcagaaagtgacacgagactccggcgaaccggatttaagttagaatatacaaactattccaataagtcaagttgtttttaaagagcgggcccaagccgcaatttcttgaatattttcgggttttgtccggcagcagccgccaatcagcctcgctcctttttcatgccaggtgcgggcgctcgccccgtaagattctgcgcatgctgcgccgttccacgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgttcatcaagccatgatgcgcagtcagctgcaggtgttccgtcactgatatgcaggccgtctttagcactgaagctgatccatgcatacgtttcaggaaattccttcaacagccgaacaatcgctttggcttcagtcagacacggaatcgtttcgcatgccaaaacatcagctccggcttcaatcagcgccttcatccgggggcgatgaaattcaatcagttcatcttctgatattgcgtagttgccgcgatactcagacccgtctgcaagataagcgccataagggcctatagaagccgcaatgatcggttttggccgattcaaacggttctcttcaagcgaccaaaattcatcacgtgcttcagctgcgatgctgacggacaactcgatgagccggcgtgcttccgcttcgctcagcccgcgtgcggcaaagccttcaaatgtagactgatagctggcagtgattgcacaatcggcgcctgccgcgaaataatcagtatgtacttgtttaatcagatttggctcttccatcaggatttttgccgaccacagactgtcattcaaattacagcccttgcgttcaagctcggtcgccatggcgccgtctagcacaataagcgggtatgtatctagtatgtgttggataggattcatagaatgtaccgatgccttctttcagatttttttgaaaaagatatgaaaatcgtaatggaggcttacgtgtttgtcaataaacgcaaaaagagaaaggtgttcagcccatatgtctgaacaccttttcttatgatatttgtttgttgtgcgtgtcagtctttgtgtctgaaaccggccagcactcaatgccattgtggtttttgagcacatttttataaaagaccggatctttgcctgcttttttctggcgtgtatagtctttcagcgccgtaaaaacgacctttgatagtaagaaaatcgcgattaaattcacgacgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccgattaaagcacagaatccgaataacaaaatcagaatggcgagaaagcctgatgcccatgatccgacatgggagctgagagaggcttgtgtcaaggcgattccgctcagacccggagtatgataggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattccccgtctgacgccttgcatgagtgccgcgcccaaagccccgccggcggcctggtcaaaaccaaacgcatttttcacgattagcgcaagcacacctggcagctgcgtaatgttggagaaaatgacgaaaaacgcaactccgatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgaccgtattggattgaaccgagttgaagacgataccgaacgataaggtgattaacacagcgaacagcgcgcccatccaccttttgttcagccctttttccatgtaatacgccggcccgccgcggaagccgtttacatcttttactttataaatctgagccagtgtgctttccacaaagctcgatgctgatccgataatggcgataatccacatccagaagattgcaccgggcccgccgagtgcaatggcgatagcaatgcccgtaatatttcccgttccgacacgggctgccatgctgatgcaaaaggcttgaaacggagaaatgctgtttttcgaccgggaagcagcaccttctcttaataccctgaccatttctttcagcatgcgaacctgtaaaaacttaagcctgaacgtaaaatagattcccagagaaaggagcaaaacaattaatagctttgaccacaaaagatcatttgcaataccgacgatatgttccaggatttgctgcatacaatcacctcttttttcatgtttaaaaaatgctgagctcccactcctgcgccatatgcttcagcagcataccgccagtgaggctgttgccgtattcatcaatggcaggcccgtaaatgccgatgccgcatccggattgaaaaggctgttctcttctggcacttggaggaaccagcgccatgatgccaccggagacgccgcttttggccggcacgccgacaaacgccgcatatttgcctgaagcgttgtacatgccgcacgtcagcattaatgccttggccaattttgccacatcttttggaatcacctgctcgcgtcgaatcggatgatacccgtcatgagcaaggatcaggccgatcaacgcaatatcttctgtggtgctctccatagcgcattgcttcaagtacacctcaagtgtttcttctacgtcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactcgagcttttcgtatgccgattctccgggaaggatcgaagcgatggtgagggcgcccgcgttgatcatgggattgaagggctttcccggcttgttgatttcgagccgaataattgaattaaaggcgtcacctgtcggctcgacatctacgcggtcaagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaaagcggggatatagtttgcgctttgtccattggcggcaaaagggcgatagtattcaacccaatcatgaagctgtaacgccgggtttatgtctttctggtgctcttttatcaattctttcatcgaattcctcctcactgattttttcttaaaggactgaggtgtatcaaaacgaaggctaagggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaattaaaagcgaggatgtgatcaacataaaactggaacggtttattgaaaaagacggatatatattggccctcatgctgattacggtgccgctggccggtgaactgaaattttatcccctcaatgaagaattccgggtcagctttggggcaccggtttttttcttctttttatcattgttgcggcatgtgcccgctgtgctgccgggttttctgactggagcggctgttttcatctttcgcgtctttctggaattatggggcggaggacacaatggactgactccgattctgtatgatcaagcgtctggctttttcttttatatgacttatgcctgtctgttttccatattaaaggccaatcgtttccgtgaacggccgattatgctcggtttcattgggtttatgattgaagttgtgtcagattgtgtcgagctggctgtgcaatttctcatttttcatacggttgtcacgcctgagaaaatcactgacattgcggtgattgcgatttctcacacatttattgtgatgagcttttatagtgtgctgaagctatatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaagggcaaggatgttcagctgagcggcagaatcctgagactggccggagaaattcatgaagtgaaaaaggacaaccagcggatattcgcagggctttcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggcccagggatttccgagaaaatcggagacattgtgtttgacccgggctttacttcaaaatatgacgaatttggcacgccttctacaggtatcggactttcctacgtaaaggaaatcgtgacagagctagaaggggatatcacgtttgataatcagcagcggggagtggtgtttgccatcaggctgcctgtccggcatttgattcagaaagggtgaaccgaaagctatgcgtttttttattgcagatgatgaccgtgcggtgcggtcaattttaaggcagatcattgaggacgaagatctcggggaagctgctggtgaagctgacgacggaagccaagtggaagggcatatgctgcaatttaagcagattgatattttattaatcgatctgttaatgcccggaagagacggcattgagacgattcgtcagatccagaatacgtactccggcaaaatcgtaatgatctctcaagtggaggcgaaggaaatggtcggggaagcgtactcgctcggcatcgaatattttatccataagccgattaaccgcattgaaattgtcacggttctccaaaaggtgaaggagcggatcgagcttgaacactcgattggagccatccagcattctctaagccggcttgtcaatcggactgaacggaaagcgcgtccccagcagaagagtgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgttaaaacaaatattcacccaagtagcggtacggaagctggggacaggggcctcacaaacggacgtcaatcgcgaaatgaaagcctcggagcagcgtatccgcagagcgattattcattcgctgcaccattttgcttcactgggcacaactgatttttcgaatccaaaatttgaaacctatgcatcgaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgaccaggctgtttttttgctgcgcagaatcccggccggacagtgatttgccgcttttttataaaatatcagaaaataaagatattgacttattgtttatttgtcttacaattaaacaaaaggatatatggggaaggagcggatgtgaaagaaaaattaataaaagcgcttacagatagaggctgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttatcgcttgcgggtctggtgaattccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgattctgcctccgtatttggtgcatggcgaacaggaggggctgtaccagtatgcgaaaacgattattgaaagcactgacttgaacgcgattctttatcagcgcgataacgcagttctctctgttgaacagatcaaacgtctgaccgaatgtgaacagcttgtcggtgtcaaagacggggtaggaaatatggatttgaatatcaacctcgtctatacgatcggcgaccgcttgggatggctcaacggaatgccgatggctgaagtgacgatgccggcttatctgccgatcgggttccactcttactcttcagcgatttcaaattatatcccgcatatttcgcgaatgttctatgatgcattgaaaaacggaaatgacgagcttgtgaaggaactctatcggcatgtgattctgccgatcaacgacattcgcaaacaacgaaaaggctacgccgtatccttgattaaagccggtatggaaatcatgggtttgaatgtaaggaatacagccagaccgcctgtcggcccggttgaaaaagatcattatcagcaattggaagcaattttgaagcaggcggctgaccgttttccgaaaaaagccgcgacggtttgaccagaaaaaacacgaaaggggcaatgggcatgtctgtgatcacggaacaaaacacgtacctcaactttattaacggagagtgggttaagtctcaatcaggcgatttggtcaaggtcgaaaaccctgccgatgtgaatgatattgtcggatatgtacagaattcaacggctgaagatgtggaacgtgccgtcgccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacattgccggaagcgaagggagaaacagcccgggggattgccattctgcgctattacgccggagagggcatgcgaaaaacgggtgacgtcattccgtctactgacaaagacgcgctcatgtttaccacccgtgttccgctcggtgtggtcggcgtgatttctccgtggaacttcccagtggcgattccgatttggaaaatggcgccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcgggcaggggcttgctgagcatgacggtgtaaacgccgttacgtttaccggttcaaatcaagtcggaaaaatcatcgggcaagccgctttagcgaggggagctaagtaccagcttgagatgggcggcaaaaaccctgtcatcgtagctgatgacgctgaccttgaagctgcggcagaagcagtcataacaggggccttccgttcaaccggccagaaatgcactgcgacaagccgtgtcattgtacaaagcggaatttatgagcgctttaaagaaaaactgctccagcgcacaaaagatattacaatcggagacagcttaaaagaggatgtatggatgggaccgatagccagcaagaatcagcttgataactgcctgtcatacattgagaaaggcaaacaggagggcgcttcccttttaataggaggagaaaagctggagaacggaaagtatcaaaacggctattatgttcaacctgccatctttgacaatgtgacaactgagatgacaattgcccaggaggaaattttcggtccggtgatcgccttgatcaaggtggactcgatggaggaggcgctgaacattgccaatgatgtgaagttcggtttaagtgcatccatcttcacggaaaacatcggccgaatgctttctttcattgatgaaatcgatgccggactggttcggatcaatgcagaaagcgcaggtgttgagctgcaggctccctttggcggcatgaagcagtcgagctcccactcccgagaacagggtgaggcagcgaaggactttttcacagcgatcaaaaccgtttttgtgaagccgtaatggtgctggaaagaggcatgcgtctctttcccagctttatcacagccagcatatgattctctactttgaaaaggagaagatactatgaaaaaagactttgcgaatgttacaccggcgggcaaaaaaacgtccgtgcgctggtttatcgtgtttatgctgtttcttgtgacctctattaactacgcggatcgagcgacgctttccatcaccggagattccgtccagcacgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcattttttctcctttaatgggctggcttacccactctttcggctggcattccgtcttcgttgttatgggtattgcgggcattcttctggctgtcatctggctaaaaacggtgtatgaaccgaaaaaacacccaaaggttaatgaagctgagcttgcgtacatcgaacagggcggcgggctgatttccatggatgacagtaaaagcaaacaagagacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtgcttgggggcattgtgtcagacatcttgctcaaaaaaggccgttcactgacctttgctagaaaagtgccaatcattgccggcatgctgctgtcttgcagtatgattgtctgcaactacacagattcagcatggctcgtcgttgtcattatgtcgctcgcgtttttcggaaaaggcttcggcgcattgggttgggctgtcgtgtcggacacgtctccgaaagaatgtgcaggattaagcggcggtttgttcaacactttcgggaatattgcctcaattacaacaccgattattatcggatacattgttaatgccactggatcttttaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccgatacaagagcaggttcaaaaagagaaaagatcgaatattccctcaattactgaaatgaaggtgattcctgttgcgggacacgacagcatgctgctgaatctaagcggagcacacagcccgttttttacccggaatatcgtaatcttaacggacagcagcggaaatcagggagtcggcgaggtgcctggcggagagcatattcgccgcacactggagctgtcagagccgcttgttgtcggaaaatctatcggtgcgtaccaagcgatattgcaaacggtcagaaagcagtttggcgatcaggacaggggagggcgaggaaatcagacgtttgatttgcgcaccactgtgcacgccgtcaccgcactggaagcggctttgttagatttgcttggaaagtttcttcaggaaccggtcgcggctttgctgggcgaagggaagcagcgtgatgaagtaaaaatgctcggttacctcttttatatcggcgaccgaaagcggacgaccttgccgtatcaaagcgatgagcagtcagattgtgcgtggttccgtctgcgccatgaggaagcgctgacgccggaggccattgtgcgtcttgccgaatccgcacaggagcgctatggctttcaggatttcaaattgaaaggcggggtgctgcggggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccgtgcggggatgagaatggctactccgctcgtgaagtaatggctgaattccgccgcgcgacagggcttccgactgcgacaaatatgattgcgactgactggcgggaaatgggtcacgcgattcagctccatgcggtcgatataccgctggctgatccgcatttttggacgatgcaagggtcggtgcgggttgcgcaaatgtgcaatgattggggtttgacatggggctcgcactccaacaaccactttgatatttcccttgcgatgtttacccatgtggcagcagcggctccggggcggatcacggcgattgatacccattggatctggcaggacgggcagcaattaacgaaacagccttttgagatttcttctggctgtgtcaaggtgccggataagcctggactaggcgtcgatattgatatggaacaagtggaaaaagcgcatgagatctaccggaaaatgaatttaggcgcacggaatgacgttatcccaatgcagttcctgatccgcaactgggaatttgaccggaagcgcccgtgtcttgtgcgataagtttgtttgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggccggagacaaattgccgacagaaatggaactgatggacattttgcatgtcagcaggccggtgctacgggaagcactcagttcacttgaaacgctgggcgtcattacgagaaaaacacgagggggcacatatttcaacgataaaatcggcatgcagccgttttccgtcatgcttgctttggccactgataatcttccggctatcattgaagcgcggatggcgctagaactcggactcgtgacaattgccgcggaaaaaatcaatgaggaagagcttcagcgtttgcagaagacgatcgacgatattgccaacagcactgacaatcattatggtgaagcggataaagagttccatcgaattattgcgttaagcgccaataaccccgtcgttgaagggatgattcagtccctgctgatcacccatgcgaaaattgacagccaaattccgtacagggagagagatgtaacggtcgaatatcacaaaaaaatctacgacgcccttgccaaaagagatccgtacaaagcacattaccacatgtatgaacatctgaaatttgtccgtgacaaaattctaaaaggaatggatgaaaaataatggtgagcaaccgcagttgaaacgtaagagctgcggttttttttaaaccaatttagaaaacgcttactaagatatgaggagtgattttcatatggcgatgaacctcaggaagaaccaagcccccctttacatcaaagtgcatgaaatagataacactgcgattattgtaaatgatggaggactgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagagtgccgcagccgcggccccctcttgaaggctacacgtttgagggataccgaaatgcggatggcagtgcggggacaaaaaatatcctcggcatcacgacaagtgttcaatgtgttgttggcgttttggattatgcagtcaaacgaataaaagaagagctgctgccgaaatacccaaatgtcgatgacgttgtgccgctgcatcatcaatacggatgcggcgtggcgatcaatgcgcccgacgctgtcattccgatccgcacgattcaaaatctcgcgaagcatccgaacttcggcggagaagtaatggtcatcggattgggctgtgaaaagctcctcccggaaagaattgcctccgaaaatgatgatgacattctatcgctccaggatcaccgaggttttgcggcgatgattcaatccattttggaaatggcggaggaacggttaatcaggctgaacagcagaacccgggtgtcatgcccagtttcggatctggtaatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcgggctgtcagtgaagaggtcggacaatcactgatcaaagagatgaagtggtatgacagctatctccggcggggagacgcagaccgaagcgcaaacccgtcaccaggcaataaaaaaggcggattatccaatgtggtggaaaaagcgttaggctcggtagcgaaatcaggcacaagccccatctccggcgtgctcggccctggtgaaagagcagagcaaaaaggcctgctgttcgcggcgacaccggcaagcgattttgtgtgcggcaccctgcagctggctgcgggcatgaatctgcaggtgtttacgacagggaggggaacaccatatggcctggctgctgcgccggtgctgaaagtatcgactcggcattccttatcagagcattgggctgatttaatcgatatcaatgccggtcgaatcgcgacaggagaggccagtatcgaagacgtaggctgggaaatcttcaggacgattttggatgtggcaagcggccgcaaacaaacgtgggcagaccgttggggtctccataatgatttgtgcttgtttaatcctgctccagtgacttgattcatgtttttatagcggaaagatggaatatgctgtaaaatgaaaatcagcgtataggaaacggaggggttacagcatggcattcattagattccgagtgacacgaattcaatagtgaacaactctcgcctgaatgcgagagaatcgggatgaatccgcctatgtatgagcccttacatgattatcaaaaaagagggtggcgtgcctgcccttttttgtgccttcaagcatcccttctctctactgcaggccggagcatgagaaaggggaaatgggatgacaaaccttaacgaaaaacagcttatcactgagattgtcgggcttgcacgcagccaaggtttgacggttcattctgagaacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatctgactgctgatgtgccggattggagaattcatacaccggaattgatcgcttacccaatgttaaaaggaacgccggctgctggaattgacttggaacaaaagcaatatgtatggaatatggatcatcagccgccgtcagacgactttgtccgcacacttgccgacatactggctgaattacatggcacggatcaaatatctgctgggcaatccggaatagaagtgataaggccagaagatttcaggcaaatgacagcagactctatggttgatgtgaagaataagcttggcgtatctacgacgctttgggaaagatggcaaaagtggatagatgatgatgcatactggccgggtttctcttctttgatacacggcgatctccacccgccgcatatccttatcgatcaaaatggacgtgtcacaggacttctggattggacagaagcgaaggttgctgacccagccaaggattttgttctttatcaaaccattttcggagaaaaagaaactgcccgtttgcttgaatactatgatcaagcaggcggccggaaatgggcaaaaatgcaggaacacatctcagagatgcaagcggcatacccgttggaaatagctaaattcgctctgcaaacacagcaggaggagcacgtcaatatggcgctggaagcactcggtgtaacatcggattaagaattgacttcgtttcatgaaccgagtattataaactctacaaataatagaacggatcaacaatcgtgaggaagagcaagtacgcatcagaatggaggttcagagagtcggtggcaggtgtgaaccgatccttccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggttttttgtgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctaactgctcaaggatatacgcttctggattttatccaaaagcatttgaataagtaaaggagaaaagctgagctgagatgagagcagaagagcagagtaagattcgtgaggccgcagcaggtacaatttttttgctgatcggaacagtttgttttgcgtctaaatcgatttggataaaatgggcataccaaatgggtgctgagccagatgccgtgctgctatacaggcagctgctggctgttccgctgttttggctgatttttttaatataccgtcctccaatgccagacggtaagaaaaaaggagacctatggaaggcttgtggcgcgggaatgttttgtttttttctgtctcccttgcttgattttatcgggctgaaccatgtatccgcaatggttgaacgtatattgctgatgagctatccgttgtttgtgtttggattcgccgcgtgtcgtgaccggaaaatgtcctcaattcaggaccttttcgcagttctggcggtcatgtttgggcttttcttggcgctgggcggctggaatgctgagcttttccaggcgaatatgattggagctgtattcattttgttatcttcggccgtctatgctggttatcttgtcctttccgggcatctcgtccatcaaatcggggggatccgtctcaatgcatacgggatgacagctgctggagctgccatgatgctttacacagggataaaatcggcggctggcatgaatacgccaatggcagcatatccgctttctatgtatggtttgttcgcggtaattgcagtcgtaaccactgtgattccatttgtgctaatgcttgagggcataaaacgaatcggggcacagcgagccgccgccatttcaatggcagggcctatcctgacgattttctatggagctttatttctcggtgaacggcttcggcttattcaagtcattggatgcactgctgtattctttgtcattacgggcatggaatacaggaagctgaaaacaggaaaaaaagaataatttttataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgctttcgacggagaagagggcatccggctgtttcagcaggattcatacgatttggtcctccttgatatcatgctcccgaagctgaacggaatggattttctgaaaatcatccgggaaaaaagcaatataccggtcttaatgatttcggcaaaagacggagatgtagacaaggcattgggactgggttttggggcggatgattatatcgccaaaccgttttctatgattgagctgacagccagagtaaaagccgcgatacggcgggcgacgcaatattcggcagaggagccggctgtgaataaggtgatccggattcaccagcttgcgatagatatagacaatgtttccgttttgaaaaacggagagccgcttcagctgacgtcaacagaatggcagctgctgtgcttattcgcatcaaatcctaaaaaagtgtttacgaaagaacaaatctaccgttcggtttggaatgaagagtactttgatgatcagaacatcattaacgtacatatgcggcggctcagagaaaagattgaggatgacccctcctcccctcaatatattaaaacgctatggggcatcggttataaattaggagagttttagaatgacagtgctatgggtggccgctgtcatcgctctggcgtgtctgaatgtgattcaattcataatgaaaaagaagcgggacgggaatctggcttacacggctgaccagcttagctacatgctcagccgggattcggcagggcaaattttgcttcctacagacgatcatgcgctcaaaggcttgcttgttaacatcaatcttatcgttgagaatcgtcagcagatcagcgcccaatttgccaaaacagagcaatccatgaagcggatgctgaccaatatgtcgcacgacctgaaaacgccgttaacggtcattctcggttatatcgaagccattcaaagtgacccgaacatgccggacgaagagcgggaaagattgctggagaagctccgccagaaaacgaatgaactcattcagatgatcaactccttttttgatttagcgaaattagaatctgaagataaagagatcccgatcaccaaagtacatatgaacggcatatgcaaacgaaatatcctgcactattatgacgctgttcagtcaaaaggctttcaagcagccatcgatatccccgatacgccggtgtatgcgcaggcgaatgaagaggcgctggacagaatcctgcaaaacctattgtccaatgcgattcaatatggcgcggccggcaagttaatcgggctgacgctgtcttatgatgagaggaacatcgccatcaccgtatgggatcgcggaaaagggattagtgaaaccgatcagcagcgggtgtttgagaggctgtacacactggaagaatccagaaataaagcatttcaaggaagcggcttgggtttaaccatcacaaaacggcttacagaaaaaatgggaggcaccatatccgtccaaagcaagccgtacgaacggactgcatttacgatcacattgaaacgcatgacatattaatcgtaagaatttcttaaggtttgagaaataaaaatgacagggctcgccgctacaatagaaaacaggaaaagagagggaaggagaaacaaagttgacttatatcgtacaaacaaacgggctgaccaaaacgtatcagggcatagaggtcgtatccaatgtcagcatgcatattaaaaaaggtgaaatctacggctttctcggcccgaacggcgcggggaaaacaaccattatgaaaatgctgacgagccttgtcaaaccgacaagcggtgaaatcatcattcttgggaacaagttcacccacacgtcatatgaggtgctggggaacatcggcagcatgattgaatatccgattttttatgaaaacctgacagctgaagaaaatttagatctgcattgtgaatatatgggataccacaataaaaaagccatacaagaagtgctggatatggtgaatttaaaacaaatcgacaaaaaacccgtcaaaaccttttccctcgggatgaagcagcgccttggaattgcgcgtgccatccttacaaagccggatctgcttattctggatgagccggtgaatgggcttgaccctctcggcattaaaaaaatcaggcaattgtttcaagtgctgagcaaagagtacgggatgacactgctgatctcaagccacctgctgggtgaaatcgaacaaatcgcagacacaatcggcgtcattcgggacggcaggctgcttgaagaggtatcaatggaggatgtcaggggccagaacactgaatacatcgagcttgttacatcgaatcagacaagggcctgctttgtgctggagaaagagctgcaattaaccaactttaaaatattaaatgagaaaatgattcgaatttacgaggctgaagcctctcaggctgccatatccaaagcattgattttaaatgatgtagacattgaatcaatgaacaaaaagtatacgtcgctggaggattattttatcaaattgatcaacggcaatagcatcagtgcgtaaaggaggagagacacgttgatgaatttgatcagaatcgaattaagaaaaatgaaaatgggctggtatatcagaggtgccctcattgccaacgtgatcattatgggttttatgtggctgatcagttattccgaaaaagccgatggcggggtttcgttccaaagtacggatgaagcattcctcatcatcggcaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccgccggtttcttttggctgaactcgatctgccatttcataccgggagagcttacttccgagatcatttctcaacaggcggtcaaaatggcggttttcgcttttggcgccgctggaaccagtttagttcccatcttttttgggatgcgtagacactcggttccggcgaccatcatttcatctgtagtaattgtgatgctcatcagctcaacaagtccgggcttctcgatttcatctgttgtgtatatcccgttatcgttagcggcattcggattgttcttttcctacatggcgatcaggaatgcggacaagcaggatgcgtaaacaaaagcgcccaataagtataaaaggccgatgctgtcagcaccggcctttctattatgagtctgttcttgtttcaagataatgcttcttgccaatctctttgctcatcatatagaaatggaagcaatattcaccgattgccatgacgatcgcgccgaataaagccgccaacgcaacttcaccgccagtcatccccagggaaagcggcatgcccatcagccagatcacaagaaaggccaagccaaaatcagccaaagttgcaatcatattattccatctcggcaatacataaagatcgcccagcaaataagaaataacccctaacacaatcgtcattagcagcgtatcaccaaacgtgaaaccaaagcccagaccaagcaccagatacaacacaataatcgtcataatacctttaatcgcgagcgctttcacatgtgtcattacaattcctccttttgtcatttgatttgttatgtataattcctcaaatgtaaaaagttaaaccttatttcttttcggaggcgggtgcaaatctgctggggaggggtcaatgatgtgaatccaggaattgaggctgcggcgcttcgacagcggaaacgtgaagcttgtactgcaccggacgctgctttgatgcccaacagcccattatgtttgctgtttttagatgaataaatttaaaaacttctcctgtccctccgtcatcacttctgaagtaatgaaatatgatgaaaagagatcaaggggaggtgacgtgatggcggtcgtgagagcaacgagtgcggatgtcgatttgatggcaaggctgctcagagcggaagcggaaggcgaaggcaagcaggggatgctgcttgtcggcaacgttggaattaatcggctgcgggcgaattgctcagattttaaaggcctccgcaccatcaggcagatgatttatcagccacacgcgtttgaggctgtgactcatggatatttttatcaaagggcgcgagatagcgagcgtgcccttgcacgccggtcgattaatggtgaaaggcgctggcctgcaaaatttagtttatggtatttcaggccggaggggaactgtccagcccagtggtataaccagccgtttgtggccagatttaagtcacactgcttttatcagccgacggcggagacgtgtgaaaatgtatataacacattttagagacaggacaccgttcaagttgaacggtgtttttctttgaaaagatgcaatggaaaatattcctgtgagataatcgaagaaaaaagagctgacggagatgacagaatggcaacaattgacctgcaaaagaaaagtgtaaagatcgcactggagaaaaagcagttaacgaaggtgacggctcgtgttggactggttcttgatattacgggatcgatgagaccgctctacaaaaacgggacggttcaaaatgtggtggagcggattttggcagtggctgatcagtttgatgataacggtttgctggatgtatgggtgtatgataatgaattttcccgattaaagccagtttcagaaaaggatttttcgggctatgtcgatcgtgaaattttaaataatgaccgcttgcataaattcggcagaaatgatgagccgccagtcatgaaggacgtgctgcgcaaatatgttacggaggaaccgagctcgtatcctgctttcattgtttttatcaatgacgggggctgtaaaaagtcaatcaaaccgataattgaagcttcttctgataaaccggtgttctggcagtttgtcggcatcggaaacggaaactttgattttctcaataaactggatacgttaggagggcgtgtcattgataacacgaacttcctgcatatcgaagagattgaccgcatttctgatgatgagctttatgatgctctgcttgctgaatttccatcttggctgaaagaagcgaaggaaaaaggaattgtaagagatcaagagccacctgctgaaaagccgaaaaagaagggctttttcagcagattgttttcgaaataactgataaggcactgagtcattcagcgaaatggctcggtgtttttgtttttttaagatcatgtgaagaaaaatagtccgaatgggcggcttgcaaacgacaggatatgcagaaaacgcgtcattcagccagctttcggcatgtttcagcggcaggcttgtgagggaagacctgtttttaatgttcagcgcttacaatcggttcacacttcttcacagtcgtttaacaatgatttcctataatggagacgatcaatgagaagagaggggatcttgaatggcatacgacagtcgttttgatgaatgggtacagaaactgaaagaggaaagctttcaaaacaatacgtttgaccgccgtaaatttattcaaggagcggggaagattgcaggactttctcttggattaacgattgcccagtcggttggggcttttgaagtaaatgctgcgcctaaattctcaagctatccgtttacattaggggtagcgtcaggtgatccgctttctgacagtgtcgtgctctggacgcgcctggcaccagatccgctgaacggcggaggaatgccgaagcaagcggtgcctgtcaaatgggaggtcgcaaaggatgagcatttccgcaaaatcgtaagaaaaggcactgaaatggctaaaccgagtcttgcccattccgttcatgtggaagcggacgggcttgagccaaacaaagtgtactattatcgtttcaaaaccggccatgaactaagccctgtcggaaaaacaaaaacactgcctgcccctggcgccaatgtgccgcaaatgacctttgcatttgcttcctgccagcaatatgagcacggatattatacggcctacaagcatatggcaaaggaaaagcttgatcttgtcttccatctcggtgattacatatatgaatacggcccaaatgaatatgtatcaaaaacaggcaatgtccgcacgcacaacagcgcggaaatcattacgctgcaagactatcggaaccgtcacgctcaataccgttctgacgccaatcttaaagctgcacatgcggcattcccttgggttgtaacttgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcgtccttcaatgtgcttgatacccgccagtacagggacgaccaagccaataacgacggcaataagccgccttctgatgaatcgcgcaatccgaatcggaccctgcttggaaaagaacaggagcagtggctcttcaacaatttgggcagctcgactgcccactggaatgtgctggcgcagcagattttctttgccaagtggaatttcgggacaagcgcaagcccgatctacagcatggattcgtgggacggctatccggctcagcgcgaacgggttatcaatttcattaaaagcaaaaatctgaataatgttgtcgtactgacaggtgatgtacatgcaagctgggcatcgaatttgcatgtcgatttcgagaagacaagttcaaaaatattcggagccgaatttgtcggaacctcgatcacttccggagggaacggagcggataagcgggcggatacggaccaaattttaaaagaaaacccgcacatcaagttctttaacgactatcgcggatatgtccgctgtacagtgacgcctcaccagtggaaagccgattatcgggtgatgccgtttgtgaccgagccgggcgcagccatttccacgagggcttcattcgtttaccagaaagaccaaactgggttgagaaaggtatcatccacaacaatccaaggcggggcgaagcaatccgatgaggtcgaagaggatcgtttctttgcgcacaacaaagcccacgaaaaacaaatgattaagaagcgggcaaaaatcacgaattaaggagtggaaattatgttttcaaacattggaataccgggcttgattctgatcttcgtcatcgccctcattatttttggcccttccaagctgccggaaatcgggcgtgccgccggacggacactgctggaatttaaaagcgccacaaaatcacttgtgtctggtgatgaaaaagaagagaaatcagctgagctgacagcggtaaagcaggacaaaaacgcgggctgaatgctgatgaggcagacaccgggtctgcctctttttttatgaaagggagggcttttttgaatggataaaaaagaaacccatctgatcgggcatttagaagagcttcgccgccggattatcgtcacccttgcggcattttttctatttctcatcacggcttttttgttcgtacaggacatttatgactggctgatcagggatttggatggaaagctggctgtgcttgggccgagtgaaatcctctgggtgtatatgatgctttccggcatttgtgccattgcggcttctatccctgttgccgcgtaccagctgtggcgtttcgttgcaccggcgctgacgaaaacggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttaggtttatggtgaatttgagcctgccgttcggcttcttgtttgagatgcccttggtggtgatgtttttaacaaggctgggcatcttaaatccttacagactggccaaagcgagaaagctatcctattttctgctgattgtcgtgtccatattgattacaccgcctgattttatttctgattttctcgtgatgatcccgcttcttgtcctgtttgaagtgagtgtcaccctatcggcgtttgtctacaaaaagaggatgagggaagaaacagcggcggccgcttagtgcagcgtaccacccggtgacttcacatcctcatcatattgtgcggccgtaacagcggcgattctcaatgcccggacaatcgtgtccaggctgaggctcggcgctgttttgtcgattgtttgctgcggaatgtaaggaatatgaataaaaccgccgcgaatgtgcggggatgtccggctaatgtgatccattaacccgtagaacaaatagttgcatacaaaggtccccgctgtgtaggaaaccgcagctggaatgccgtgctccttcatcttagcagtcattcgtttcacgggaagccttgtccagtaagcggcgggcccatctggagaaatctcttcatcaatcggctgatgtccttcgttatcggggattcgcgcatctgcaaggttgatcgccacccgttccggtgtaatctgcatccgtcctcctgcttggccgacacaaatcacgatatctggctgatgtgtttgaatggcttggcgcagagtgcccagagcggatctaaagacggttggaatttgttccgctgtaataatggcttcttccgtctcgaagccattaagccgtttcgccgcttcccatgatggattgacggtttctttgtcaaaagggtcaaagccagtgatcagcactttttttcccatcttctcatctcctttttcttttattctattgtttatttatgggtttttcatcaaaataatgtaaaggagtaaatcataatggagcatttaccgcagcagtatcgtcatttattcccaaccttgcagacgcatacgatgcttgccagctgttctcagagcgcattggcagagcctgtatcaagggcgatccaggattatcatgatagcctgctgtatatggggacgaactggaaagaagcgatcgaaaaaacagagtttgcgagaaacgagtttgcaaagctgatcggggctgaaccggatgaagtggcgattgtgtcgtcagtttctgatgcgctggtttctgtagcatcgtccttaactgcatttggaaagaagcacgttgtatatacagatatggattttccggcggtgcctcatgtttggcaggcacactccgattataccgtatccgtcattccatcaatagacggtgtgatgccgctcgaacagtatgaaacgcatatttcggatgaaacagtactgacgtgtgttcctcacgttcattatcgtgacggctatgttcaggatataaaagcgattgccgagatttctcagagaaagggctctttattgtttgtagatgcttatcaatcagccgggcatattcccattgatgtgaaggaatggggcgtagatatgctggcagcaggcacccggaagtatttgctcggcataccgggtgtggcgtttctttatgtgagaaaggagctggctgacgcactgaagccgaaagcatcagcttggttcggaagagagagcggatttgatggggcttatgcaaaagacgcgcgccgttttcaaacgggcaccccagcttttatcagcgtatacgcagctgcagcggctttgtcgctgctgaatcatattggggtttctcatatcggggatcatgtcaaaacgatctgtgccgatgcagttcaatatgccgctgaaaaaggcctgcagctggcggcggcacaaggtggggatcagccgggcatggttgcgatccgggatgagcgggcatcggaaacggcggcgttgctgaagaagaaaaaagtgatttgcgcgccgcgggaaaatgttatccgtctcgctccccatttttataatacgaaggaggaaatgcggtacgcgattgatgaaatcgcggcgaaaacgatccacaagtaaacataaaaaaagcccctgaacattagtcaggggcttttcatattaatgatctaccttcacgcgcttcataaagaaagcgccaatcaaaccgataatggcaacaatcattgcaaacacaaatgcgtgctgtacacccgctgtcaaagcttgtgggatgactgccggatcggcagggtttttaactgtactcatataatcatgctggcctgcagccataatgctgaccgcaaccgctgttccgatagcgccggccatttgctgcagcgtgttcataatggcggtgccgtctggataaaattcacgcggcagttggtttaaaccgtttgtctgtgcaggcatcatgatcatagaaatcccgatcatcaagcaggtgtgcaggatgataatcagcacagctgttgaagtggtcgttacatttgagaagaaccatagtacaactgtgacaatcacaaatcccggaatgacaagccatttcggcccgtatttatcgaacaagcggcctgtaacaggggacataaatccatttaaaataccgcccggcaagagaacaagaccagatgcaaatgcagtcaggactaagccgccttgcagatacatcggcagaagcagcatagatgacagaatgaccatcatacaaatgaacaccatgatcacacccaaaataaacatcgggtatttgaacgcacggaggttcatcatcggctgcttcattgtcagctggcggattgaaaataggataaggccgacaacgccgacaatcagcgacacgataacagtcgggctggaccatcccccggagccttcacccgcgttgctgaatccgaacacaatgccgccgaagccaatcgtcgacaggatgatagacaatacatcgattttcggctttgtcgtttcagatacattctgcatatatgcgataccgaacacaagcgccagcacaaggaatggaagagagatccagaaaatccagtgccagttgaggtgctccagaaccaatcctgagaaagttgggccgatggcgggcgcgaacataatgacaagaccgatcgttcccattgcggcgccccgtttatgaggcgggaaaatcaccaagattgtgttaaacattaggggcagtaaaagaccggttccaagtgcctgaacgatccttgctgctaataaaaacgagaagctcggcgcaagcgccgcgatcaaggttcctataattgaaaagattagtgacacggtaaaaagctgtcttgttgtgaaccactgtaacagcagtcctgaaacaggaacaaggataccgagtacaagcaggtagcccgtcgttaaccattggacggttgccgctgtaatgttcaattccttcataaggtcggttaacgcaatattcagtgctgtttcactgaacatgccgataaaaccggccaacagcaaggaaatcataatcggcatcactttgtattgctgagatgctttagctgttgtttccaaaatcatttcccctctctatcaactgcatgtaggatgtcgtttttttatctcttcagcaggtcaggaatgcagctggagatatgaaggagcggcgtactgttttttgccgtcaaagataaaagaataccgccttcaatcatcgcgttaaccacagtgctggcttcttttgcacggctctcgctgcagccagtctgccgcagtttttcctcatatacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtgtaggcttccatgcagtccgcgattttctgacggatatactccttcatctcatttacggcttcgatcgcaagctgttctttacctccgggaaagtggtagtaaagagagcctttaggcgcaccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaattactgagagaaaagctgactgatcttttgactgaatagataaaatgttcaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaaggtctgccaaacattagaattttagcgacaggaggcacgatagctggtgccgatcaatcgaaaacctcaacgactgaatataaagcaggtgttgtcggcgttgaatcactgatcgaggcagttccagaaatgaaagacattgcaaacgtcagcggcgagcagattgttaacgtcggcagcacaaatattgataataaaatattgctgaagctggcgaaacgcatcaaccatttgctcgcttcagatgatgtagacggaatcgtcgtgactcatggaacagatacattggaggaaaccgcttattttttaaatcttaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaaccacaacagatacatttaaatcagaagaaatgggcttcgtcggaacaattgcagatgatatctattttaataatgagattacccgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgacgcagccgaaaaaggggcggacagcgcagtcaaaaaaggcgtcacagtggtgcgctctacccgcacgggaaatggtgtcgtcacaccaaaccaagactatgcggaaaaggacctgctggcatcgaactctttaaacccccaaaaagcacggatgttgctgatgcttgcgcttaccaaaacaaatgatcctcaaaaaatccaagcttatttcaatgagtattgaagaaaagaaggcgaataagccttcttttttttggctttttaggaccaataatgacctctgaatcttaaaatttctttaaaaataagccaaaattaccctttacttaattaatttggtaacgtaatataattggagaatttgttacaaaaaaaggaggatattatgaaatttgtaaaaagaaggatcattgcacttgtaacaattttgatgctgtctgttacatcgctgtttgcgttgcagccgtcagtaaaagccgctgaacacaatccagtcgttatggtacacggcattggaggggcatcattcaattttgcgggaattaagagctatctcgtatctcagggctggtcgcgggacaagctgtatgcagttgatttttgggacaagacaggcacaaattataacaatggcccggtattgtcacgatttgtgcaaaaggttttagatgaaacgggtgcgaaaaaagtggatattgtcgctcacagtatggggggcgcgaacacactttactacataaaaaatctggacggcggaaataaagttgaaaacgtcgtgacgcttggcggcgccaaccgtttgacgacaggcaaggcgcttccgggaacagatccaaatcaaaagattttatacacatctatttacagcagtgccgatatgattgtcatgaattatttatcaagattagacggtgctagaaacgttcaaatccatggcgttggacacatcggccttctgtacagcagccaagtcaacagcctgattaaagaagggctgaacggcgggggccagaatacaaactaatgagataaataaccttgaagagtcctattcttcaaggttattctgcttttagcacaatggttttcgccgccatatcatgaacggtttgttttttcttcgtaaatgcggcagtcaaatagatcaggcgggagaacacatgcacccacgctatcaggtaacggacaatggcttgcgggaaggatatttttttatatgtttcgtccctcacgatttgcagcccgatgatttttttgcccagtgtgcccttccaatttgtcagcggcatcagcaaaggatacacaatcagcatcaatatggcgacaataatgacaccggcggacccatcgccaaacgtaaatccggctgccaaaatcactgctgcggcaatgattacatcaagtacaagcgcgcaggcgcgcagcatgaaaccagctagttccaatagaaacactccttaaaatgttaaataaatacctaatgattgtaaaaaagaagggcctaaagtgggaataggtgataagccttaaatcacaaaagttggtgaaaatgtcataggtaaattggcataatcagccagcttatcacattaccaaattcttttttagcccgaaaccaagccctcagaagttatttttgttaaaatagaaaagttacaacagaattcggagggtttattgtgggaaaagtgaaacgaaatgccccttgcccatgcggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgattttctttctgctatggacagacagacgaaagacatcagcgtatttaacttaggaatctggggaatcttcttccacccgcttgctggtgagaagacaatcttcgaagagtaccttcagaaaaaaggcgattcgatcactcgtccgaaaacgcgtgagatcgtagaatcatggcagagcatgacgcctgctttattgctgctgaaggacctgaaggaaggcatcattcactttgaagatgtgattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggaaggcaaaacgccggaggacttcatgaagcaggaattcaacaacgttctgttcgcgttgttagctgagaaagatgaagagccacaagcagagaaagcggaagtaagcactgttgagtgggcaaacgacttggagaaagaaaccgctgcggctattgaagaaggcatgagcggggaagagtatccgactgaattgatcccagctgttattgacatctggaaaacattctgcgagaaaaaatcacctgtcatcagaaagccggaagcttttgctgcggcagttgaatattatgtaaacgcgatttctcttaacggcgcgtctgtttctcaagctaaactggcgaaaaaatacggcgtcagcgcatcaacgatttccagccgttacaaagaaattgaaagcacgctgcaagatgaagcagatcgttttgcccaagcgttatcctcataatgaaaaaaaccttgaaaagcctggcttttcaaggttttttatttctgaaacggaattttgatttctaaccggaagacggggtggcggtaggtaaaatccagcctgccaaaagcgctcttcaccagtttttgaatgatatatgtgcccatgccttcatgagcgccgtttttcgttgagcggccaaacgattgataaattgtatcgagcacttttggggccatcccgggagtgctgttttcacaagtcagtacataaagtccgctgcgcagtgaagtctcgagtttaatctctgctttttctcgggtctccgccgcgctgtcgagcgcgttttctaatatgttgccgaccaagctgacctgatcagcaggcgaaaacggaagggaagaaagcggtgtatgcatatgcagcgaaacactcacattcgaggcgcgggctttttctaaaaaatcataaagcacccctgcaacgtacgcgttctctcctttcaaaaaacggtcatattgactgtattgatccgcccagttttgaatatatgcttgtgtatctgccttgggctgagctgatttgattgcagtgatatgtttcattgtgtcatgattccggcttctcacatcaatcagcatttgattggcgtgctgttcagcttgcgtcagcttatcaatttgatcagaaagccttgcctgcaaagcagactgtccgatacggagcccttcacaccctgcaaatattacgattacacataatgcctgcatgatgtctgtgccgatcagcaccactcccgccgacatcacttgaatcacggcaatccatgcacaaagccctgaggaacagtgtttccacacccgcttcgtattccaaatgtacaatcctgcagcagctgcgcctaaaacagcggtgagccaagagactgctgtgctgtgtgaaagagcagcagctccctgataacatatgaaactaaataaaaccagataaagacattgaaaaagggtaatcacgttccgaactcctcaaaaatagtagttttgaaaataatcaagctgctgcttagtgatcatcgcttttttagacgttccctcaaaggaaactgtgaatgaatgcttggtataagcggaaaaatgctttatgtaatgaatgttgataataaaggaacgatgcgaacgaagaaaatccttttcgggcaggtcgcctttaatattatttaatgtttgatacgtttgcacctcttcggcggttgtcacaatcgtcgtcgaacgtcccgtccgttctgcgaaaataatatccttcttttgcaggacgtgcatttcagacttttgctttatcaatatacgcccattcaaactcgtttccgttttctttttcaagtaccggtcgaaggaagcggccagacggtcggcatagtacggcttcataatataatcatggacgttcaggtcaaaggcgtgaaccgcataaccgccgtggccggtaacaaaaatcacatccacatcaagtgaatgggatttgatcaaatcagcaagctcgtagccagacatatggggcatctcgatatcggcaagcagcagatcaatgtctccgttctttacccgcctgtaggcttccttcgctgaatcggtggaaaagacaatttcgacgtcctgcattctggacacgatcgcttccagcttctctaaatctactcgataatcatctacaagtccgacttttaccattatcattcccctagttacatagaatcatctttattctatcccatttcacgacataaaaagaactcttcgcgacaactttatccaactaatccagcttttcgtatatagtcattactagaaataaagataagggagattgtgacatgataacactgaccgattgcagccgcaggtttcaggataagaaaaaagtagtcaaagcggtgcgagatgtaagcttaacaattgaaaaaggagaagtcgtcggcattctcggagaaaacggtgccggcaaaaccacgatgctgagaatgattgcttccttgcttgaaccatcacagggtgtaatcacagtagacggctttgacacggtcaagcagccggctgaggtcaaaaaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaacggttcggcatgcgcgattatatgaaccggagagtgggcgggttttcgaaaggcatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttgcgcgacagaaaaacgattttactcacaatcttagtgccgatgattatgatgcttggacttgtcttcttttatgaaagcatgctgtccgacaaaggggagcagtacacgctggctgtcggccattcgcttccgcccgcactggaaagcaagcttaatgagattgacgaaatcagcgtaaaaacatttgcaaagcctgaagaggcagttgatgaaggaaaagcagatgcctatctgaacgtcccgaaagagttcgactcatatgtcaacagcatgacaccttttaagattgatgtttacggtaattcaatcgatcaagggtcgtcaaatgccatgcagcttgtgcagtctgccttagatcagtacaaaaatgaaattgtgcagcaacgtttaacaaataagcatattgatcaatcggtgatccagccgtttacgattcagcaaaaggaagcggatgaggagaaagggacttccgctattatgctttccgccattctgcccatgctgattctgacttccattgtttccggcgcaatgccgatcgctcttgatatcatggccggtgaaaaggaccggaagtcaatcgaggcgctgctattaacgccagtcagcagaaacaaagtgctggtcggcaagtggcttgcggtttccacttttgccgtggcttcaggtgtattggctttggtgtttttgattttgtccaccgtgttatttaccgaaaatttaaaaacggccttccagctgggagatcatatgtggagtgtaatcggcgcttcagccttaatcattgtgctctctgcattgctgatatctgcgatggagcttttcatcagcatcatgtccagctcggtaaaagaagcgcaaagctatatgtctctcgtcgtctttctgcctgtgttcccgatgtttttcatcttcagcaaggcaccgaaccaatttgacttatcatactttctcatcccgtttctgaacctgcatgcgttatttaaacagcttttattcggggtggttgacccggctgccattttgtctacgtcaggaaccatcgccgtgctcatcgccatcttctttttactagccagagcctgcttcctgaaagacaaatgggttcttccaaaataaacttgcgaaaggagaaatacactttctcctttttgtatatcctgaaaaaagaaggaaaatagaaaaaggatatctaatacaaaaagtgaccctgcactatttttcatcaaaattggtttctaaggagaaggaacaatggatcaaacacgtacactcggcaaaacgaagctgaaggtgaagcggatcggattcggcgcgaatgcggtcggcgggcataatctatttccaaatctaaatgatgaaacagggaaggatttagtgcgcacggcattggatggcggcgtcaactttatcgataccgcctttatatatggattggggcgatctgaagaattaatcggcgaagtcgtacaggaacgcggcgtgcggaatgagctcatcatcgccaccaaaggagctcataaagaagtgaacggcagcattgaattagacaatagccgggagtttcttcgcagcgaggtggagaagagcctgaagcggctgaaaacagattacattgatttgtattatgttcactttccggatggaaaaacacctctcgctgaagtggcgggcactttgaaagagctgaaggatgaggggaaaatcaaagcaatcggcgcttcgaacctcgattatcagcaattgcaggattttaatgctgacggctatttggaggtcttccaggccgaatattctctcatacagcgtgatgccgagaaagagcttctcccatactgtgaaaaacaaggcatctcctttattccttactttccgcttgcgtccggactgctgacaggaaaattcacgcaagacacagtctttgatgatttcagaaaggataaacctcaatttcagggtgaaacgtttatccaaaatctcaaaaaagtagataagctgaaagcagtagcagaggaaaaacaagcggatacggcacatgtcgccttggcgtggctgttaacgagaccggcgattgatgccattattccaggagctaaacgacctgagcaattacaggataacctgaaaaccttgaacattgaactgaccgaagatgaagtgaatttcatcagcgacattttcaaataaaaaaggaaatagcctccgaggctatttccttttggtgttttattctttgatgaatgcttcgactaattctgctgctctgtaatcatccatatcaagctgccattggtcgatgtcatttttcttcatttttacttcaactgttttttcagatgaagcaggtccaagctttttaaattcctcagggtagacttgaagcgcgtatttcactgcctcttcatagctggcactagagtttttactgtagtagtctttcactttgtcttcgatacggtctgaaagagaagatgcatctacaggtttaactgtggcttcaacaattgcttcgtctttagagattgaagtcgtttttgcttgaatggaagagtttttgcttaatccctctttaatgccgttcacgatattatcaagcgctttgctgtccgcatatgtgctggaaaggccggaagctgagagataaccgtctttggctgattcattaaaatcatttacaatttcatttttgttagcgccggtgattttttcgaaatcggcgttatctttgccgaaaagaaggacatcaacataagctgataacgcttttgcagaatcttggagcttatctgccgtcgccagaatttttttgtcttttccgtcaattttaaaagtaactgattttggctttttatcaccgtaagattccggcgtatagttgagctcgtattgcttgcctttatctacaacgaagaaaagatttccttcaacggatttgtcagcgttaatcgtgctgccttgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagcgtataagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaagggagtcttttgtctttgagaaatggatctttttgaatggattagcatcatataaccaaaaaaatcagttcttttctcacggttttcaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttggagggaacttaagaaggatgaaaggggccgcctttgtgaagaaagagggactgaaacaaaaagcactggaaatcggccgggtgccgacacacttaaaactggaaattgaagattatggcggtgatgataaaagagctcatttttgttgggcagatcctcaggatgagaataccggcattatcgtggagcttggaccggacggagagctggaatccctttcccgtgatattgagcctgaaagcggagaaaggctgtctgaggagaaactagaggatatcatgcgccaatttatcgagactcatcatccgggggcactctctgcctttgttcgtgaagaaaatgaccgtgcatacggcgataaagtgagattttcatatgttcaaatggaggctgggcttcctctccccatgagcggatttatggctgatgtttccttatcaggtgagattgtttacttccgttattacggcgaagcgggcagcatcatcaagccaaagcgggtcgcggatgttgaagaggcacttgcctttatcaagaaggacgtggagttcgaccttttgtttgaggttctccatcgttctgtttacaaaaacggagatgatcagccgcatttggtgtacgagcctgaaggtagggcgattaccgtacctgcggatttggttcaagaagaacaagcagttgatgatgacgatgattacagggagccggagagctttcctctccctttattcgagggcatccgcgaaaaggccgatcctgacagcatgattggtattgaaaatgggtttgtcaaagagcgggaagcggatttgggagatgggagaattggaatcgtttggcggaatccggatgaccctgtgtatcagccggcggataaaagcatggacagctggtttaagggacggactcatcaagtgctgaaaaccatctataacaaagaaaccggaaaactcgaaggcgtcatgtcatttatggagaaaaaagggccgctgacagtaaccttggcagagtgtgaaaaaatcgcgcttcgctttctatttgctttatttccgaatgccgatcaatattttaggatcagatacgacgaaaaagatgaagaagaaaacgcagtcgctggttttacgtttgaagcgcattgtcacggagttccgctccgatttgggcagatcagaatttgtgtcagccgccagacagggtatatcaccgtttatatgggaccggatattgacccaaataagctggcaaccattgatcctgtgccggctatttcagttgaacaagccaagtctatcttttggcagcattttaaagttgagcttggctgggaaagagagtacggggatgatgaagaacacagctaccggctcgtctataagccggtgtatccgcattttatcgatgcacatacaggggagcctgtcttcagcatatggtgaaacagccaaaagtcacgcaattgcctcagatatagaagagagtatgtgatgaaagtaacagaaagaatctcaaaaaacaatgacaataatagaaaaggacctttcttcactttaaatgaagaaaggtctttttatataataaacaggattctctttgtcgtagactctttgaaagggatgacttcattggttaataaacagctgaaaaagaaggcgcaggagatcggaaatgtaccgacgcattatgagcttgagatagaagattacgaccaaaagcaaaagaagtacgggcaggcatattttatctggaaggaccctaaagatccggaaaagcacattacagttgaacttagaaatgacggcgccttgctcaccttttcaacaactgtccactccgagacagacaaaaaacttccagatgccgagctgaagctgacggctcttcagtttgccgctgccaatcatcccggcacatttatgaattttcattttcaaggcaaggaagaaagggggcagcacatccggtttgtctataccaaaatggagctggggcttccgattcccaattcaggctttttaattgatatgacacgaagcggtcagattgtccactttctatattacggggaagggcataaagccgaagttccgacggaatttgtagcaaaagagaaggttgtatcccattacttaaacacaatgtcttttgagctgatgtacgatgtcattgatggcgaacaggaaccaaggcttgtatatgaaccgattctaccgggatacagctatcccgcagatgtagacgaaattgtgcccgaccagcatatcgcagatgaaagaatagaaaacacggcgccactgccgccgcttcagaacaaggaagaagttgatatatttgccttgctgggttttacctctgatatgcagaaagtcagtgaaagagactttggagaacaaattggaagcacgtggcgcaggggcgctgcgccggagcgtaaggatttaagcataggaagctattttgaaacgagaaataaaaatacaatcaaaatgaagacggataaaagaaccggaaaattaaaagcagcgctttcttttatggactggcggaacaacctccaatgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttgattgacgcttttatggcgcctgatattgaacctgaacaattggaagcgataaatcacaggccggatgtttccgctgaagaagcgaaagaagcatttttagccgcttttgatgtgaaactggaatggcagcctgattttacagcaggcagtgaccagcactgcaaacttgtctataagccggtttacccttcctatattgatgcgcacataaggaaaaagaaaaggctgtgaggggtgtctagttaggaatcatctccaagtgggggtagtccttgaatcgtttccaatccccgccccattcgaaaccgagtgtcttagcgatctcgacaacctccagccaatctgattttccgttttgattgccgtcatattccatatcccatatgatgctgccatcctttttttgaagggcgaaatcaatcgctaaaccatagttatgatacgattcccctcctcttgcataggtgacaatattccctttttttgtacgtccctgtttatataattcatcttgttccttaaaggacctgaatccttcagtaatgacgacgtcaatgcctttattcgctgcagcggctttgagtgcatcggcattctgcttcacaatcggatgaagatccgaggggacaggcatgtcctgcaaggcgttttgagaatgccattcatgccgaatataactaaaacaaagatctagaagaaatagaatacataagataacaaatgtttttgcgggtaagttcatatcggtctcactttctcaagatgtgctgaatgttaacgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatatgatttagaagatatggaagagaatcaggacttgcttttatatttttctttgatggaattccggcatcgaatcatgcttgataagctgatgccggtgaaagacagcgacaccaagcctccgttctctgatatgctgaacgaaattgaaagcaatcagcaaaaactcacgggcttactggaatactacttttattatttcagaggaatgtacgaattcaagcagaaaaatttcatattagcgattgaccattataaacatgccgaggaaaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactgtacggtcgccgccgggttcagtgtgaatttatcatcgccggaaatttgaccgatgtgtatcatcatgaaaaagcactgacccacttgtgcagcgctttagaacatgccaggcagcttgaagaagcgtacatgatcgctgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaggcagtagaggcttatgaccgcgggataaagagcgcggctgaatgggaggatgacatgtacttgacgaaattccgcctcattcatgagctgtatcttggaagcggcgacctgaacgtgcttacagaatgctttgacctgctggaatccaggcagcttcttgctgacgccgaagatctgctgcatgatacagcggaacgtttcaatcagttggaacattacgagtccgccgctttcttttaccgcaggctgatgaatattaaaaagaagcttgccgagcagcgttttcaataggaaatggcagagaactacaggttctctgctttttttgtgctgttttcaactcggaaaaacagggtattttccactgcatagtgagaaacagaggaggatatcaagtatgtacaaagatttaaccggaaaaacagcgattgtgacagggtcttcaaaaggaatcgggaaagccattgcggaacggttcggacaggagaaaatgaatgttgttgtaaattaccacagcgacccgtctggagcagatgaaactctggaaatcattaagcagaacggagggaaagccgtctcagttgaggcggacgtgtcaaaagaagaggggattcaggcgctcttggacacagctttagagcatttcggcacgctcgatgtgatggtaaacaactccggttttaacggcgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcatcagcagattccgcgccctgtaaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcagcttggctcgtatctgaggaagcaagctatgtgaccggcgcaacacttttcgtcgacggcggaatgacactttatccatctcagcttgaatagaagacaaaacagggggattgcgggatgaaaacagactggtggaaggatgcagtggtgtaccaaatttacccgagaagctttcaggacagcaatggagacggaattggggacttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgtagctattattattggcgtcccggcacaaagaacggcccgccgacggactggctctcaaactatggatgcccggtctggcaatacgaagagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatcacagatgaagtgttttctcattatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtaatttattttatgaagggcacgccgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaaactattacaaaaagctgatcagcctgagaaagcagtacgctgacctcatgaaagggagctttgatcttttgcttccggacgatccgcagttgtttgtatacatgagagaaaacagtaaacaacagcttttgtcggtcaataatttttcaaaagagcaggctgtttttcagtggcctaagaactgcggcaaagctcaggcctcactgcttctcagcaattataacaacgatgatcttgatgacgaaatggtgttccggccttatgagagcagggtctatcttctggacaaaacaaactaatgattgaagtagcccggcatttttagccgggtttttttagtacatatattcgctctgcaggcgggaagaataaatgaaaatgaaatttattcttgcaaaacgtaatgacttcggtttattatgatataggattacaaaatcgttatcattttgatttaaagttactgaaaaagaggggatatacgatatgtttaaaaaatggagcggtttgtttgtgattgcagcgtgctttttattagttgcagcatgcggcaactcatcaacaaaagggtcggcggattcaaagggtgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgccaacattcaggatgctgatttgttcgtttataatagtgaatacatggagacatgggttccgtcagctgaaaaaagcatgggccaaggccatgccgttttcgttaatgcaagcaaaggcattgatttaatggaaggctctgaagaagaacacgaagagcatgatcatggggagcatgagcacagtcatgcaatggaccctcacgtatggcttagccctgttctggcacagaaggaagttaaaaatattacggctcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctttcacctgaccaagaaccgagcgcagccagcttggcaaagctgaaaacatatgccaaagaacataatgtaaaagttatttactttgaagaaattgcatcctcaaaggtcgcagatacgctcgccagtgaaatcggcgcgaagacagaagtgctgaatacactggaaggcttgagcaaagaagaacaggataaaggtttagggtatatcgacattatgaaacaaaacctcgatgccctgaaagattcactattggttaaatcataagatagtgtgcgccggaggggtgcacactatttctttgtgagaaaggaagattaacatgaatctcgtctcattgaaagatatcgttttcggctattcccatacgcctgttttagataaagtatcacttgatattgaaagcggtgagttcgtcggcatcactggaccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggatttccgagcacggtgctggagcttgttcagtcaggccgctatacaaaagggaaatggtttaaacgtttaaatgaagaagatcatcttgaagtagaaaaagcattgaaaatggtggaaatgtgggacctccgccatcgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcaccttgtgaaaaatcacaaccgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggcgcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagttaaccagcagcaggtctatattatcagtattatcacactgctgatcctgctttattttatcgtactgagaaggccgctctacctgctgacgtttgatgaagcaacagccaaaacatcgggaatcaatacaaacgttctctcgttgtcattcagtattgtcacaggccttgcgatttcagtcattattccgatcatcggggttcttcttgtatcggccctgctcgtattgccggcagccttcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaagaagccgataacatgaaaagcagttttccctagggaaaactgctttttttatagaaacaatccggcaaggcgctcataagattcttttttcgcctcaaaatcaaacacattgcacagaaccatgatttcatttgtttcgtagcagcctgtgaggtctaacagctgttgtttgacagtggtgggagaaccgatcaccatccgctttctgttttcttctatgagttttttatcggacgctgtatagggatgagctttcgcttcctcgatgcttggcacgcggctgtccaagccttttccgacgcgaagaagccacaaatcctggcttaatgcgagttcttctgcctcttcatctgtttttgcgcaaatgacaaaaatcgtaaacagtgcggatggattcgaaaaatgggctgagggccgaaagctttcccggtagatgcggaatgcattttctcctcgctcgggattaatgaaatgcccaaatacatatccaatcccctgttgcgccgcgcgtcttgcgctgttttcaccaagaccgagcacccatagctcgggtgccgtgtcaataaggggcgccgctttgattccggcatacggatggtcgggaggaagggaatctgttagaaaataagagacatcctgcagctgtctgttaaattcggttaagctttttttcaccccgtccgttaatgcaagcctggtttttgtcgtgccgccgggggaacggccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtgatgctcggcaaaccaataacgcttatagccccactgttcgcttaattgggcaagctcaaccgaatgctggagagttgtcacagggctttctcctttagaaacaggtgcctgatcaagtatgcttaaatgaatcaaaaggccgcttcctttctgtctgtttttagatggtgacaccagaataggcaaaatgacttgcccgcgtcaaattgtttgtttaagaagcgtactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacatttcgatgagtaggagtgaatcgtgtggcaatttctttagaaaaaggtcaacgaattgatttaacaaaaggaaaagccggtctgtcaaaattgatggtcggtctcggctgggacccagtgtcctcaggcggaggattcttcagcaaactgcttggcggaggcggtccgaatatcgactgtgacgcttcagtgctgatgctggaaaacggaaaattcaccgataagaaaaacctgatttatttcggcaacctgaaaagccgctgcggcggtgtacagcatacaggcgacaacctgacgggtgacggtgcgggcgatgacgagcaaattatgatagatttagataaagtgcctgcaaacatcgataagcttgtatttgtagtaaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcggtcggtgaaggcacaaacgatacgagattagaagatattatcagccgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcgggcacgactttgatcttgactcaagtgtgtttctgttagacgccgcgggcaaatgcgcgtcaccaaacgactttattttctacaaccagcttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctccgcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgacaaaagcggtgatcggcttaggctgggatacaaacaagtactccggcggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcaaaaatccctgctcacattgagaaaatcggcatcacagtgaccattcacgacgctgaagcacgcagccaaaactttggacaagtttccaatgcatttgtccgcgttgtggatgaagaaacgcagaatgagcttcttcgcttcgatttgggagaagacttctccattgaaacagctgttgtcgtttgtgagctttacagacacggcggcgagtggaaattcaatgcgatcggcagcggattttccggcgggctggctgcattgtgccggaattacggtttgcaagtgtaagcgagtgacaaatagagaagtcaccgtttcaaattaataggaggaaaaaacttggactttttacatcatattttgtctacgtatgcttcatttttcgattggaaaatgtggggggaagttctgactgatcctgtttcctggggtttgatcggttcccttgttgttctggaaggccttttatcggccgataacgcgcttgttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggattggcgaaaaagaagaggaagcggacggcatcaagaaaaactcttggatggtccgcacgtttgggatcttctgggcgactgtcatttcagtagaattaatggatcttgccttctctgtggacagcatcctggccgcgtttgcagtatctgaaaaagtatgggtgcttctgatcggcggtatgcttggtattttaatgatgcgtacagtggcaaaagtgttccttgtgctgattgataaaattcctgagctggaaaacacagcattcgtcttaatcggcattatcgcgctgaaaatggcggggagcgctttccattacgaaatgccgcactccgtattcttcattatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgtttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggtcagatattgggcacgcctattgatgagacggactactataacgagctgtatgagctgtctgtaaacgaccgtataacgattttgagtgaaacgcttgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccctgatgcaccgccatttaagaaaagcgctgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgagagatgccgaagattgtttggtatggagatgcgacgaaaagccagctctatttcttatattatctgatgctggtcggctgtgatgtactactgttccatccagcgggaacggatcagctggcgcttgtcgacccgaagcaggagctcagttttacggaaaagctcccggatgtttcggagcttcagccgtttccgaaagaaaaaccagaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagctgataaacattcaattgagattccgaatgtattcgccaaaattatgggcgtgtcgaaagacaataaggaatattggaacaggcttcatactctagcggattatcaggaaacagaaatggtcagaagctttccatttacagaagaaataaagtcgaactatcaatttcactacagccacgcacttgatcaagaagggtacattgatccggacaagctgatggcaagcaatgtgtggcagtacaaacagctgccggcgggcgttcagactgccattgccaaaacgatttcgagaatgtgcaggcacccgcggcttaaagctttgcatcaggaacaagtcaaggatgttcaaatctatttgtttaaacaaacaacaaatctgcctgctaatctgctgaaattgattcaaatgttcgactatgcgcaaaccgttccgaaactcgttttatatcatacggaaatgagcggcggactcacgcgttcggatgctgctgccctgctgttcctgaatgaaattggaatcgatatcatcatttataatccgcccggacaccaagatattgagcagtttattgaagatgaccagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagcttcgtcaggaaccagaagtgaagcggcttgctcaacaaattgacgtcaaaaaccaaatggagctgcttgagtacggcaaggagccggccgttgaaatatccaagttctctgaccgcatcttagggatgatgaaaacaacaagcgtgacagactccggcacaatgctgactcagcttgggaaaatcatggaccgcttcgacaaaaatgattttgatgagccaaagggattaatggcgaaaattttcaaacgcggcggcagcatgattgaaaaaatctttaaaaagtatcagacacttggcggagagattgaaaaaatccacgttgagatttcaaaatacaaagatgagatgacgaagacgaactacacgctcgatgaaatgtatgaaaacaatatcaaatactatatggagcttgaaaaatatgtcgttgccgggcagatgaaactggaagagatgcagtcgatccttccttcatatgaggaaaaagcggcaagcgggaaccagctggcgcaaatgcagctcgatacgttgcgcaacggcattcaggcgcttgaggaacgggtgtatgatctggacatggcacggatggtggcgcttcaaaccgcacctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgaacttgaccgccggacaaacgagatgctgaaacgaaatgctgaaaacatctcgagccaaagtgttgaaattgccagaatggccggcagaccgagcatagatattgaaacgatcgaatcgtcttggaacacgattgtcagcggcatgcaggaaacaaaacaaatcgaggaagaaaacaaacgcctccgcgaagacggcgcgagacgaattgcacagcttcaggataatattaaaaaagcagcattgcagcaataataaaaaccccgcttgtggaacataagcggggtttttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaagaaatgaaatggatcggaagcgtcaattccatcggcatggctgcgggtgcgtttttgtttggtttgcttgctgatcgaatcggccgcaaaaaagtgttcatcatcacccttttatgcttttccatcggaagcggcatttccgcttttgtgacgagcttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataccaagctttggctggcaggctgccctgctgttaactgcgctgactgctttttatgcgctgtacctgcggacgagtctgcctgattcgccgaaatatgaatcgctttctgccaaaaagaggtcggtgtgggagaatgtaaaaagcgtctgggcaagacagtatatacggccgacggtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctaccgggctatttctctgccgcatggctgattgaaaaagcgggccggaagtggatactcgtcgtttacttgattggtacagcaggaagcgcctatttcttcggaacggcggattccttaagtcttctgcttacggctggaatgctgttatcgtttttcaatctcggtgcatggggagtgctgtatgcttataccccggagcaatacccgactgcgattcgagcaacaggttcaggaacgacagcagcgtttggaagaatcggcggcatcttcgggcctttgctcgtcggaacgctcgcagcccgtcatatttcgttttcggtcatcttttcaatcttttgcattgcaatcttactcgcggttgcttgtattttgattatgggaaaagaaacgaaacaaactgagctagaataggaaaagcacctcttaaaagaggtgctttcagcgtgtcgacaaaccctcgcattcgttgtcaggactgcgcttcggtgctcaatgcgaagtggatcaacggctaaattctcaggcgtcctgcctaaacgccgtcgtcatcacatcctgtgaatgtccgctcctatgctcgtctttcctagacttcaagggttttcaatcacgctgaaaagattttgtcaacaatctgaggcacctcttgaatgaggtgctatttttacatttgcgcccgggctgcggattggcgtttcccggttttactgattgcctggtagagcgtcatagaaagtatgaacaaaatggcagtaaatcctgtgacagctccgaaatgctgtgtgctttgatataaaaaacctgcaatacttgtaccgacagtggtcccggcatacatagcggcattggaaagggaagcgatggttcctcgcgcatttggtgcaatggattgaaagacacccatcattaacggaaagatgatgccagctgtaaagaacgtgagaaaaaagccggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagtacccagaaagctgaacgatgcgaagtttccggtttgaaacagaaaataggcaagcagaatgaccgatgttttcggcaatgaaaaaagctcccgataggggttgacaattgatgggcgcgccaatggttcagaaggcaggatatcaggcatgaccgccgccaggatcaatagaagaataagcgagcacgctgacaaaacgaaaaatggcgtatgccatgtaaaggaagcgagaaaccctccaataggaagtccgagcatttgtgaagcggccaaacctgctgtcgcaatccccatgccttttatgatctgagaaggctggacaatgactgggatggacgcccaaatttgaggcgtcacaaacgcagcgctaacgcctgcggcaaaacggaacaggcacatggcggcaaaagagggagcgatgccgcataaaaatgtggatacgataaagcctgcaagtccccacagcatgactgttttcctgttcagccggtctgagattgggcctgcaatgaaagcgaagagcgcataaccgagtgcataagcactgaccatccagcctgacaaatcagtagagacatgaaactgatcctgtaaaagggggagaagcggcgaaagcaaaaaggtatccgtgccaatgacaaacatgacactgaagaaaagccaaatgcgattcaaattttatcactcctattgttttataactttgaaactatgaaacagatatgtatagagaaaaccctttgttagagggtttccaaaaagccaggcaggtatgtttgaaatgtgtcttcacgcagactgacgtattttgtacgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataatgggtgttggaaaagcaacttatttttccagtaaaggagcaggaagtcataagaggaaggaggaattcaattccaataaaagcgttttcaactaaagataggagaaaaatcacccgtaaaatacaatcatataggaggattacagagcatttagaagcataaataagatcatgtggtcacatggatgtttataaagaaatggtacagaataaaagagaatatgctgtttgtgtgggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggtgttaatcaggcagattttgaagtatatgatggtgagatatttgtcatcatgggtctatcagggagcggtaaatcaactttagtacggatgttaaaccggcttattgaaccgactgccggaaatatttacattgatggtgacatgataacaaatatgtctaaagaccagctccgggaagtccgccggaagaaaatcagcatggtcttccaaaagttcgctctgttcccgcacagaacgatacttgaaaacacagaatacggactggagcttcaaggtgtagacaaacaagagcggcagcaaaaagcgcttgagtctcttaagctcgttggactggaaggatttgaacaccaatatccagaccagctttccggcgggatgcagcagcgtgtcggccttgcccgcgcgttgacaaatgatccggacatccttctgatggacgaagcgttcagtgcgcttgatccactgattcgtaaagatatgcaggatgagcttcttgatcttcacgataatgtcggaaaaacaattatctttattacgcatgacttggacgaagcgttgcggatcggcgacagaattgtcctaatgaaggacggcaacatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgcgaaaaaagcggctgagtctgatttgtcacttcaagacatcttgaatacagaatttacgactgtaccagagaatacgtatctgactgagatttttgacgttgtgtccgatgcgaatattccaattgcggttgtggatgagaagcaaagaatgaaaggaattgtcgtaagaggcgcgctgattggcgcacttgccggcaataacgagtatatcaatgctgaaggcactaacgaacaaacacaagatccttctgcacaggaggtgaaataagatggatagactgcctagaatacctttagcagatattattgaccgttttgttgactggattacgatgacgtttggcggattcttcgacggaatcgctaacggattggccgcttttgtaaatggaattgtcaccggtcttggatttattccatctattttgttaacgattattttcgccgcacttgcgtggtggatcagtacaaggggaattgcgttatttacgttgattggattcctcctgatcgattatttaggatattgggacccaatgctgcaaacattggcgcttgttttgacatctgtgattatttcgattgtggtcggggttccgatcggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggcggatttgattgaagcgactgaggcattcggttctacaacagctcagcgtttgtttaaagttcagctcccgcttgcgacaaaaacgattttggccgggatcaaccagagcatcatgcttgcgttatcaatggttgttatcgccgcaatggtcggtgcaccgggacttggttctgaagtatacagtgccgttacacagctgaaaaccggggtcggagtagaggccggtatcgccatcgttatcgttgccattaccctggaccgtattactcaaaatattaaagtgaagaagaaaagcagggggaatgcctgatgcttaaaaaaatcataggcatcggcgtttccgccatgctggcgctctcacttgcggcttgcggttcagaaaacgatgaaaatgcatccgcagcagaacaagtgaataagaccatcatcgggattgaccccggttcagggattatgtccctgactgacaaagcgatgaaggattatgacctgaatgactggacattgatttcagcgtcaagtgctgcgatgaccgctacgcttaaaaagtcatacgaccgtaagaaaccgattatcattacaggatggacaccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaggacgaaatgggcgaaatcatgatcaaggtggaagaaggcgagaaacctgccaaagttgctgctgagtacgtcaataaacataaggatcagattgccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcgacgggaagtgcggatgcatccctttccgcatggctgccgaatacccataaagcatacgccgctaaatataaaggcaaatatgatgatattggcaccagtatgactggtgtgaagatggggcttgttgttcctcaatatatgaaaaatgtcaactcaattgaagatttgaagaagtaatcaaaaaagcagcctgtgtcaggctgctttttttgcgttaagaagcgttagcggcagcaagtgattccgccttctgaaatgttttgagcacggcgttcgccaaaatatgaatgccggtaaacatcgcatttctgtcaaaggtcatgtgcggatgatggagccccggctggagcccgcagcctagtccgagcatcgttgttttcagattcggcaccttcacggcgtaaaaatggaaatcctcgccgccggtggtgacaagcgggtcatcaagccgctcagccccgatgatatctgtaatggcttctgccatgatcgcttcagcttctttgttttgtgttgccgcaggaaggctgtgttctttttgcagctcgattttggcgctgaatgcggcggcggccgcttcacaggctctttctgtttcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgtttttcccgaggtgcggacgggcgccatgagcctcttccccgatgatcgttccctcaatgtgctggcttgatccgtgcagaatagacggagcgcagcggccgttctgtgtttcctggatcggacggacgtgaacgccatacaaatagtcgatatcatcaagcacgccttcttctatcattttcaaggcgccgccgcctttttcttctgccggctgaaagataaaacggattgtgcccttcggaagctcaggttgttttttgagcagcattaacgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcgccgacaaccccggtgcagtctgaaaacgtgcgcgtccggcaccctaaatcctcaagcttttgtttcaaaaatgaagttgtctcatattccttccagctgacttcagggttcgcgtgcagatgctcgaagatgtccataatggtttgtttcatttcttctgaaagcttttgcatggttagaaatacctccttctatcagaatgaatttttaccttctttactttatttatattgaaacagaaatataggctgtatataatatagcacatattgctacttttcagaataattaatattttcaaacagaggggatggatcgaaatatgagtatgccagcagccgaaacacagcctaagaaaaaacgtatgacatttaaaatgcctgacgcctatgtcctcttatttatgattgctttcatttgcgcaatcgcttcatatattgtgccggcaggtgaatttgaccgcgtgacaaagggggatgtcacgaccgctgttccgggaagctatcattcaattgaacagtctccggtcagcttgatcagcttttttacttctctacaggatggaatggttggatcagcacccatcatctttctgattttattcacaggcggcaccattgctattctagaaaaaacgggtgccatcaatggcctgatttacaatgtcatcagcaaattccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatatacatcggctgctacgctggatttaactccaccatattatcaccgtcaccgctcggtttatcacaatcaatcgcggagctccctcttttctcaggaatcggcctgcgagttgtgatatacatatgctttttgctgtcttctattatttatatctatttgtatacgagaaaattaaaaaaatcaaaagatgccagtgtgttaggaacagattggttccctgcggcaggaatgggcgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcgggcttgcggcgaacgatattgccaaaaccttcattacgggctgccaaagtcttgtatacggggcgctgattgtcgggatggcacgaagcatttccgttatccttgaaaatggaaagcttctcgatactgtcgtcaatgctttggcttcacttttggatggattcagcccgattgctggggcaatcggcatgtatatcgccagtgcgctgcttcattttctcatctcttcaggttctggcgaagccgttgtatttattccaatcctggcgccgctcgctgatttgatgggaatcacgagacaggttgcggttgaagcggttatgcttggagaaggggtcgtcaactgtgtgaacccgacatccggcgttctcatggcggtgcttgccgccagcggtattccgtatgtcaagtggctgcggtttatggtgccgcttgctctgatttggttcttgatcgggcttgtctttatcgtgatcggagtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgcggcattatgtttgaatttccgtttaaagaatgggctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttttttgtttggaaagcgagggaagcgttcacagtttcgggcagctttttttataggaacattgatttgtattcactctgccaagttgttttgatagagtgattgtgataattttaaatgtaagcgttaacaaaattctccagtcttcacatcggtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctctatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagacagggcattgaatgacggggcagacggttttcgatttgatgccgccaaacatatagagcttccagatgatggcagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgaggttcccggggaaaagccaaataggcgatcgcgggagtgctttatttgaagatcaggctatcactgcggtcaatagatttcacaatgtgatggctggacagcctgaggaactctcgaacccgaatggaaacaaccagatatttatgaatcagcgcggctcacatggcgttgtgctggcaaatgcaggttcatcctctgtctctatcaatacggcaacaaaattgcctgatggcaggtatgacaataaagctggagcgggttcatttcaagtgaacgatggtaaactgacaggcacgatcaatgccaggtctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgaggaccgagaaatacagttttgttaaaagagatccagcgtcggccaaaaccatcggctatcaaaatccgaatcattggagccaggtaaatgcttatatctataaacatgatgggagccgagtaattgaattgaccggatcttggcctggaaaaccaatgactaaaaatgcagacggaatttacacgctgacgctgcctgcggacacggatacaaccaacgcaaaagtgatttttaataatggcagcgcccaagtgcccggtcagaatcagcctggctttgattacgtgctaaatggtttatataatgactcgggcttaagcggttctcttccccattgagggcaaggctagacgggacttaccgaaagaaaccatcaatgatggtttcttttttgttcataaatcagacaaaacttttctcttgcaaaagtttgtgaagtgttgcacaatataaatgtgaaatacttcacaaataaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgccggagcaaaccaaaaacctggtgagacacgccttgaattagtagaaaagaacttgaagattttcaaaggcatcgttagtgaagtcatggcgagcggatttgacggtattttcttaatcgcgacaaatccggttgatatcctgacttacgcaacatggaaattcagcggcctgccaaaagagcgggtgatcggaagcggcacaacactagattctgcgagattccgtttcatgctgagcgaatactttggcgcagcgcctcaaaacgtgcacgcgcatattatcggagagcacggcgacacagagcttcctgtttggagtcacgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagatgacgtgtacatcggtgtgccggctgtcgtgaaccgcggagggatcgcaggtatcactgagctgaacttgaacgagatagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcactccgattctcttttttcttttggctttaactgttttgaaaatgaaaggcattcttgcggcatttcttaccctagccgtcagtttcttcgtctccgttttggcatttcatatgccggttgaaaaagcgatttcttctgttttgttaggaatcgggagcgggctgtggcctattggctacatcgtcctgatggcggtgtggctgtataaaatcgcagtgaaaaccgggaaatttaccattattcggtccagcattgccggcatttcgcctgaccaacgattacagctattattaattggtttttgttttaacgcgtttttagaaggcgcggccggttttggtgttccgattgcgattagtgcggcgctgctcgtcgaacttggttttaaaccgttaaaagcggcggcgctctgcttgattgcaaacgccgcctccggagcctttggggcgatcgggattcctgtcatcacaggggcgcagattggtgatttgtctgctcttgagctatctcggacattaatgtggacactgccgatgatctcatttttaataccattcctgcttgtattcttattagaccgaatgaaaggaatcagacagacatggcccgctcttctggttgtgagcggtgggtatacagcggttcagacactgacaatggcggtgctcgggccggaattagcaaacattttggcggccttattcagcatgggcgggcttgccctcttcctccgcaaatggcagccgaaagagatttaccgcgaggaaggggccggcgatgctggtgagaaaaaggcataccgtgccgctgacattgcgaaagcgtggtctcctttctacattttaactgcggcgatcaccatctggagccttcctgccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggtacagcgattttagcggcggtcatcgtgacagggctgttcagcaaaaagttctcctcccgggatgcctttgcttccctgaaggagacaggaaaagagctgtgggtgccgattatcacgatctgcttcgtgatggggtttgccaatctggccaacttcgcagggctcagctcttcaattgggttagcattggcgaaaacaggagacctgttcccgtttgtcagtcctgttctcggctggattggcgtgttcatcaccggttctgttgtcagcaataatgctttgttcggccatttgcaggttgtcacgggagcgcagatcggtgcgggttcagatttgctgttagccgcaaatacggcgggcggtgtcatggcgaaacttgtttctcctcaatctatcgccatcgctgccgcagcggtcggccaaacaggcaaggaatctaaactgtttaaaaggacagtggcgtacagcctgattctgttattgatcatttgtatatggacgtttattcttgcaagattaggagtgtaatagaaaaaagcagtacatgcccagcatgtactgcttttttatgttaatttgctttctttgtcatttcggctgttgttttcactctggctttccccataaataaaatggtaaccgccgcgaggacaattggaatcaaagcgagcaaaaacacatacgtaatacttgatgacatcgcgtcaataatgcgattcaggatcgcatcaggaatctgggaacgtgttcccgcttggaatatctcctgcgggtcgccaatattttgcgcagcacctgatcccgctgagcctttcatcccgctgaaggcgtcgctcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagatcccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgcgctgtggcaaacaagcggttcttaaacatccagaaagaaataatcggctcttctgcttttctctccacaataaaaaaggcaatgaagaaaacggcgaatacaataaacagcccgatgatctgaatggaattccaatcgtatgttttgccgccaagctcaagggcgaacatcaggcatacaatggatacgactaaggtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacactggataatccaaatacagcaccgaacatgccggacatttttccgcgtttttccggcggaaacaaatcgaagataatggtaaaggcaatcggcaggagcgcgccgcctccgatcccttgaatggcccggaagatgatcagctgattcatcgtctgggcaatcccgcataaagcagaaccgattaagaaaaaaataagtccaaacaggaaaaaacgttttcggccgtacatatcggaaagcttgccgtaaatcggcatgccagccataaccgccaccatataggatgccgtcacccaggcaaatttatcgaagcttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgattgttgaatatctcgattatcaagataaactcgattttatagggaggactgtcagttgtcaacaagaaattctagaagtgagttggaaaagactgctgttcagctttttcgaaaactgggcacaagaacggttctgtttcatcaggcagccgctcaagctctcggtctgtttcccaccgatttgaaatcagctgacattttaaatgaagcagggccgatgacggccggagagttggggaaaaaaaccggcctcagcacgggttccgtcacggcgcttgttgaccggctggaaaaagcggggtatgtggctcgtgaaaaggacccgaacgatcgcaggagagtcgtaatcgtccctttgactgcttcgaaaaaacatataaaggatttgttccgtcctctgtctgagtcgacgatggatttgtgccgcgaatatacggaagaggagctggaactcattttcagttttgtaggcaaagccgccgatattatggaggaagagcttgaacgtctgaaacagtaagtgaatttgtgcatagcttggcccgttcccgaataaattgtacaagttacataagagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggctgtcacagtttttgaccgctccatttgtgaaaacgtttttgtggctcttcggcttttttgtcctgacctataccggaattgaaacgcttaaaaacgtcagagaaccgatggatgtgcgaagctcgcgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctccttgtgtttggcttttactttggttatcagggcatcaaacagttattgggctgattcatgaaggacagtcacctgccgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctgggggacgacgcggatacgtttccgtgcattcccggacgccaggcgtttctgactgatcaacttcggattgcttttgccggagatccgcgggaaaaccgtacagcggaggaactggctccgttgcttgcggagtacggcaagatatcgcgggacacgggaaaatatgcatccctcgttgtgttgtttgatacaccggaagatttggcggagcattattcgattgaagcgtatgaagagctgttttggcgctttttaaatagactgagtcatcaagacgaaaaagaatggccggaagacattccggccgatcccgagcattataaatgggagttttgttttgacggcgagccgtatttcattctgtgcgctacaccggggcacgaggcaagaagaagccggagctttcctttttttatggtcacgtttcagccaaggtgggtgtttgatgacctaaatggatcaactgcatttggccgtaacatgagcaggctgatccgatctcgtttagaggcctatgatcaggctccgattcacccgcaattaggctggtacggaggaaaggataatcgtgaatggaagcagtatttcctccgtgatgacgaaaaacaggtatcgaagtgcccgttttcttatttaaagaacatgttcaacaaaatgaaataaatcaaggactggcagggcgatctttatgaccctgctttttttgatagatcatggtcacgatggcgatgatcacgagaaaacctatgctgacgaaaaaaccgggccggcttgatttttcaaacaatgtaccggacacagccgcagcaatcagaaccatcgctaaataaatttgcgtttttcccatgccctcgggatcagtcagctttttgctggagaacaggataaacagccaagtgtataaaagcataagccccgcagctgttgtcatatgctcataaatgtttttaggcagcactaacgacagaataatggagagaacaagccccgcaaacgtcagcccaagtgccggccagcatatttttttgccttcctttagagtaaagcatttcggcgcgtcgccgtcatcagccattgtacaaagcaatgtcgtaacggcaaaaagcgaagcgacaagggtcgagaacccggcgatgatgaaaatcccgttaaatatatcaaggatgatctcaaggttatatccttttaatgatgtaatgaacggactgtcctgttcagtaaacgcgtgtaacggaaccaaaagcagagccagcccgattgaaataatataaataatcgccagcgttgccagcatcagtttccctgatttagacgcttcctcaggtttttttaagtgaaccgccatcagccccatgacctcaattccgccaaaagcgtaaaacgcgtagattaaacctgtccacagccccatggcgccgtatgggaaaaactcaatcgtcttatttggaacatgtatgccatgatttccgccggacaggataccgcataaagccaggatggcaatgacaataaacataaaaatagcagctgttttaatcactgccagcacgttttctgttttttcaaagacggacaggccggtgaaaataataaggagcccaagtactgcgtagattgaggcaaacacccatagcggcacttgaggaaaccaatgcttcgtaaagagcgaaatggctgtcagctggcttccggtaatcagcatttctgatgtccagtacacccagccgttgctgaagcctgcccatttgccgaatgcttttcgggcatacgcacaaaacgagcccttttccggctgcttcgccgatagcttggcgagctgttcaaagacaaaatacgtaccgatccctgcgatcagaaatgaaaggagaacggaaaaaccgctttttacaattgcgatgctggaaccgagaaagaagcctgttccaatcgtgcagccgactccgatcagtgacagctgccaccaagccagattcccttttggctggtctttttttgtttggctcattatttattcaaccccttttatctaaggttagattgtgatctgtccaaagcttatatacatcggatttttgcctctttttacatggagaaggaagcagacgctcatactaatgaaaaaaggagcaaaccaatgacacagcaatatattgtggagccgaaaaaagggcttgggctgaagctgaaaaaggggcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgttaaccctgattgaagatacggtcggcaagcatgatctgctgttgcccgcctgccgtcctgatatgaacaggctcttatatgggaagcaaaaggatgagtttcaggatacgtgctatgacaatatgaaccgtgcgcttgagcagtttggcgtaccgaagccccacatgcattacccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaaccggtgctaaaggctttgtattgggaatcagcggcggccaggattcaacacttgcgggaagactcgctcagcttgcggtggagagcattcgcgaggagggcggagacgctcaatttatcgctgtccgtcttccgcatggcacacagcaggatgaagacgatgcccagcttgctttgaagtttattaagccggataaatcatggaagtttgatattaaatcgacagtcagcgctttttctgaacagtatcagcaggaaacaggcgatcagctgacggactttaataaaggaaacgtaaaagcaagaacaagaatgatcgcgcaatacgcgatcggcggccaggaaggcctgcttgtgttaggaacagaccatgctgctgaagcagtgactggtttctttacgaagtacggtgacggcggagcagacctcctgccgctgacaggcttgacgaagcgccagggaagaaccctgctgaaagagctgggtgcaccggaacgcttatacttaaaagagccgactgccgatctgctggacgaaaaaccgcagcagtcggatgaaacagagcttggcatttcctacgacgagattgacgattatctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacaggagctttatttgatgcggatatgattcagcttgaccattaatctgtcggtgaaccttcggaggctgcctctcgtatcaggatctaatgggagttcggctctcgcggcaatgttctctgccacatcctgaatcgacaggttgtctgtttgaatgtggtcctcaaaaatgggtgatgataatccttcaacacagcggttgatttgtttggcggcccatgagttttttccttctgctctggtgcgcagcctttttaacaaggtttcctttgaagccattagtgtaaagtggtgaacgatcctgccttcctgtctgagcctgccgatgatctcattgaagtattcagggtgtacaatcgtcataggcacaataatgatgccgcggtatgtatctgtcagagaagctagcaaactgtaattgaacgcccgccataaaggatagctttgaaaatcgtcctttgcgatctcctgcggcaccatggagcgcagcgcaaaacccattttctcgggatcatacacgtaagatgggttcagccttctgtgcagttcgaaggctgtttgtgtttttcccgaaccgaatgccccgtttatccaaatgatcatcgccatttctcccttcctatttatcatacagaaaaagacccttccatcgaagagtcagctggaaaaacaataaaggcagaaggttttaatgcttttttgcgtcgaagtattaaaatacctgcagaaatgttgtacaatgaatgtcattcaggcaaaaatggctaaacaacaaagcgcactataagcttgaccggtaaagccggtatctatataaatattcgctaaataatcatataatgaatataaaatttcattccttaggaggatttcgccgaagatgaacgctaaacgagccatcccagtaagagaaagaaatatcgtcctaatcggattcatgggtgtaggaaaaacaacaatcggccaattggtcgctaaaaaattatatagagattttattgatattgaccaagagatcgaaaaggatttcaatatgacaattcctgagatatttgagaaaaagggagaagactttttccggaaaacggagaaggaatatattttagacatctgccatcataaacgattcaaaatcgtatctctgggcgggggatcttttaaacaagaagaaatcaggaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggctttttttatcgttttatcccttgtatcaaaatcgcttttaaacaaaaggagatgggctgtccgttttggttcaatgtaatacagaacgtgtcgcgtgcttcgtctgatgcgtggttcaagtgggcaatgatttgtttttctcggtcagcgggggttccgcctcgtttgatccagctatcgtattgaatcggcaagttccacttttggatgtcttgataggccagttgattggcgctgaacatcgactgccattctgataatgagctttctcgaacatgggaagggtctcgaagccggttcaaatgattgacaaactcatcaagaatgggatcttcaggcgcgtaatgatcaactaagagaaaacgtccgtcctgttttagtacgcgtgcaacctcgctgacagctttgcggacatctgaaaaatggtgggctgcgtatcggcaggtgatgatgtcaaatgaatcgtcggggaaggggagtgactctgccgttccttgctgaaagcgtacgttttcaactcctttttcttgcgcgaaggaggacgcaacctcaaccatctctttcgtcgcatcaacaccgatgcactcctgtacataaggagaaaatgccagggccgtatggccggcgcccgctccgatatccagcacccgatgctctgcccggcattccgctgttttgatcatcaaccccaaatcttccccctcggcaaataccttttcatcccgatacatctcggcgtttttagaaaacggtgtttcatttgtcatttgaaccagctccttcttttcgtaaatgatgatatggattatgttagcaatttctgttatgattcgtccaagatataaaaatgatgaaaacgataggttcaacctatggaggctgaaatggatattaaagtgatggaatatgcagcggaaattgcccggcgccaaagctttacaaaggcggcggaacatcttcatatcgcacagccgtctctcagccagcaaatcaaaaagcttgaggctgagctggggcttaccctttttcacagatcccatggctctgttacactgacaccccacggcaggcgtttcattgaaaaagccgaggacatcattcgttccagagatgatttgcttcgggaaatgcaggagcgatcacagggaatcggtcataaattatccatcgggattcctgctgtaacagggagatatctctttcctccgctgctgaagcagtttttggcgcgctatcctcatgtggaggttcagcttgttgaaaaagatccggtttcattagaggagatgacggcaaagggagaagttgacctttctgttttatccttgccgatcgaggatgaacggctctccattacacccttgctcacggaaccagttgttctcgcggtgccgaaggaaaaacaaaggtggatgccgccggaaatggtcgcgctgattgagaaagcgctggaagaagatgagggccgccagccttgtgtgccgcttgacatggtaaggaacgtgccctttattctgttaaaagaaggcttcggttttcgcaggacagttctcgatctctgtgcggaaagcggctttaagccgaatgccgcctttaagacgagccatattgaaaccgcccaatctcttgtggctaacggattaggtgtgacaatggcgccgaatatggtcagaagggataaagatccgggtgtgatctatttatcaattcaatccgcgccatcacgaaccctcgtctttgtctttttaaagaaccgctatgtcagtctgaccgcccaggcctttatggaactaagccgggaaagtcttaaacaaacgtttgatgaaggctgtctgggaaacaaagatgaaaatatttagaaaacaaagccgaaacgtggtagtataggaatacaaactaaatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtccaagcagaacctgatttacagccggttgactatcctgctgacggagtaaaagtgtaccgtctcacatataaaagcttcggaaacgcccgcattaccggatggtacgcggtgcctgacaaggaaggcccgcatccggcgatcgtgaaatatcatggctacaatgcaagctatgatggtgagattcatgaaatggtaaactgggcactccatggctacgccgcattcggcatgcttgtccgcggccagcagagcagcgaggatacgagtatttcaccgcatggtcacgctttgggctggatgacgaaaggaattcttgataaagatacatactattaccgcggtgtttatttggacgccgtccgcgcgcttgaggttatcagcagctttgacgaggttgatgaaacaaggatcggtgtgacaggaggaagccaaggcggaggtttaaccattgccgcagcagcgctgtcagacattccaaaagccgcggttgccgattatccttatttaagcaacttcgaacgggccattgatgtggcgcttgaacagccgtaccttgaaatcaattccttcttcagaagaaatggcagcccggaaacagaagtgcaggcgatgaagacactttcatatttcgatattatgaatctcgctgaccgagtgaaggtgcctgtcctgatgtcaatcggcctgattgacaaggtcacgccgccgtccaccgtgtttgccgcctacaatcatttggaaacagagaaagagctgaaggtgtaccgctacttcggacatgagtatatccctgcttttcaaacggaaaaacttgctttctttaagcagcatcttaaaggctgataaatgtgaaaagccgccgcatatcatcaggcggtttttttctgcaaactgccggaatgagaacagactggagacgaatagatatgaaacaaagaatcattgatgaattaaaacggatcgagcagtcatatggagtcaaaatcgtgtatgccgtcgagtcaggaagccgcgcatggggatttccgtcgcaggatagtgattacgacgtccgctttatttatgtgccgaaaaaggagtggtatttttcaattgagcaggagcgtgatgtcattgaggaaccgattcacgatttgctggatatcagcggctgggagctgagaaaaacgcttcggcttttcaaaaagtcaaaccctccgctcctcgaatggctgtcctcagacattgtgtattacgaagcatttacgaccgcagagcagttaagaaaactgcgcacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaaccataccgccaatggactttactgttttgatgaatgaacttgttgctgaacccgagctgaaggctgaaatggaaaccttgcttgaacggaaaagaagaggggaagagcttgacctcgaagcaagaatcgatgttattcaccaattcattgaaacggaaatcgaaagaatcatggaagcggcaaaagaactgaaggcagagaaaaaagatatgacacctgagttgaaccgtttgcttttgaatacggttgaagaagtgtggaaggatggaggaagctgatgttttttgtcgcttccttttctgctttattcgacagaatcccccccgactttctaactatctgattgtggcaaatccacaaaaataatcagaatctttgtattttgagaatattgtgaacgcctgttttgtccatttacaataaactcatacaaatacttcttagattgcggggtgttgaggttggaagtgatcacaagagattttttcttatttttatccaaaagcggctttctcaataaaatggcgaggaactggggaagccgggtagcagcgggtaaaattatcggcgggaatgactttaacagttcaatcccgaccattcgacagcttaacagccaaggcctgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttggattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctactttatgagacgccttgcagaacgtccgtcaaacattgcatttgctttcaaaggaatgacaaagaagtaaaaaaggagagattatcatgacaacaccttacaaacacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccggctgataaagaagaagtcgtcggccgagtgtcaaaagcttctcaagagcacgctgagcaagcgattcaagcggctgcaaaagcatttgaagagtggagatacacgtctccagaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgacaaatgatcgaactggcaaaaggaaaaccggtcaacagccgtgaaggcgagaaaaaccaatatgtatatacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagccaggccagcagcacttaaagcgtgtcatcgctgaaatgggcggtaaagatacggttgttgtcgatgaggatgcggacattgaattagcggctcaatcgatctttacttcagcattcggctttgcgggacaaaaatgctctgcaggttcacgtgcagtagttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgttggaaacctatacttcaaccgcaactgtacaggtgctatcgtcggctaccatccgtttggcggcttcaaaatgtcgggaacggattcaaaagcaggggggccggattacttagctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattacatgctgggaggacgctctttgggtccggcagtaactgctctcagtgccggcgctgccgatatgagcggctggctgctaatggggcttccgggcgccatgttttctactggtctgagcggcgcttggatcgtcatcggactttgccttggagcgtgggcgaactggctttacgtcgcaccgcggctgagaacctatactgaaaaagcggggaattcgattacaattcccggattcctggaaaatcgcttcggagatcaaacaaagcttctcagactgttttcaggaattgtcattttagtctttttcacgttttatgtatcgtccggaatggtgtccggcggcgtcttattcaacagcatcttggggatggattatcacaccggcctgtggattgtgacgggtgttgttgtggcatataccctgtttggcggctttttggcagtcagctggacagattttgttcaggggatcattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgataacgtccgtaaaagagatcaaaagagcgcgcagaattgggatgggctggatgattttgtctgcagtaggcgcagtgctgaccggtttgggcggaatcgcttattaccatcagcgcggcatgacactgaaggacccagagacgatttttattcaattagggaatatcttgttccatccgattatcacgggttttctgatttcagcgattttggccgcgattatgagtacaatttcttcccagctgcttgtgacatcaagctctctggtagaagatttgtataagtcgatgttcagacgctcagcttcagataaagaactggtgtttttaggccgactggctgttctggctgtttcaattgtcgcgttggttctggcttgggagaaaaataacaccatccttggattggtcagctacgcgtgggcgggcttcggtgcatcattcgggccggttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatctgtcttttttgtcagcatattgacgcaggctccgtcacaagctgtcacagaccagttcaacgactaccaagatacaatgtcgcaataaagatcgaaaggaggaggaaggggctgtccctttttcctcttttctccttttaagcggccatttttttcttttggaaacaaacgtatttttttctatacaaaaagaccccgtatggatatgattaaagtaaaaaaagtataggagaaaaaggtatggaagagcttttagagagagttttttcattttcagatgttgataaactgattgattttattagctatgagctgcaaaagccagtgatactggaaagcgcggatttctttttgttagcctataattcttactatattaaccattttgattctgccaaccagcagactattttttcgaaaaagtgtccggtccagatttttgagaggtttctgaaggacggaattattgaaaaattgaaaacagagcctgagccttttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgttatcctgcacgccgcaaatggggatggggaagcggttgaggatttaaaggaaaatatcaggtcgtacctgaatttacgggataaggtcagtcatgtcttaacgatcgaatcaaacattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcacctattaaaacttggcaagagctacacagaagcacttgaagtcatcaaagccgcagaaatcaccggcaatcaggaaaacattccatatgaatatgccaaactcggcatttaccgctatttagaaagcatcgaacagaaaaatgaatttttagaatacgagaataaagatttagctttattaaaagcgaaagacgaagaaagcagcactgagctgctcaaaactttggaaatctatctcctcaacaactgcaaaacaaaaccagcggcggaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatattctgaggccagagtgcccttaatgtgaatccattcatcatccttgatgtccatgtccttcggaaattccacaagcatcccgtacacgccggaatcagcgatacagtgaatgatgccaaaccttaatacgaacagctgatttttgttaattgcgtttcctttgtaagcaaatccatgaaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaataaaggctggcatcaggccgcaaatactgtgtttgggagtagtgatctccgctctccatcgccttaaacgagaacccttttgttttgacaatggatgagtcaagcgttgcaatcgggaagaagatgcctgacaccaaaggaaaaagaaaaacaacataaatcaaataacgctgataaaatggcttgttttgttcatggtcatgctcgtgatcatggccgcatccgcaatcatggtcatggtgatgcccgcttttttcaggcgacttgataaatagatacgcttggacggcggtcagaatagccagcaggaagatcgcaataaaggacagataggaatatttcatattgatatattttgttagatttcctgaggcatgcagatgataaaagaaaaacgtaaatcccatcagcaccaatagacgaaacacccaatcacccctttaccagtagtgatcccgctaaaacaatcacgacaatgtatgtaatcagcaggaaaacaaatcgttttttgaaggccgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagggaagaggatacatcattctgcccgatcgcaagcagagtggatgttttgacatacgtctgcatagcggctgcgataaaggcgccgatgattaaatatttccccacggagaaaaattcatcaatggcatgccgcaaggtcccgcccagtttttggagcaaggtgccgtgatgatgatggtgcccgggttcatcaggctttaaaagctgggtatccttaaattgataggataagatgaccccgatgatcagcgaaacggcgagagccagtccgcctctgtaaaagaccacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataaaacctccgctcatgttaagctgcctttcttatgataccagaaaaaaaggcactgcttgtttgacggaggaggggaaaggatcgtttcactttggttaggattccaaaaagctgagtaggatactgtctgtttctgcagcttcttttccgagccaaatcaggtgtccccatgagtgaagcaaacagagagcagcgccacgaatgtgctcttttgcatgatgtgcatgtgacaagtcaaccaatccatcataaacactttgcataatcagcacgggacatatgatggcttgcaggtcttttaaagagacagcggcggtttgtgacaagtcaatcagaaatccttcacccgagcgttgccggctgttcattttccgaaatgcttccatgtctttttcatccatcaaggacttgattcgctgaaacggaagcgtgctgaattgggggctcatagctcgaaacatcaaacgcgggaaagcgttattcaaagaagaaatcagcttccatatccacttttccaccggcgggcggaagagaattctccccaatttatattcagtgtcttttggggtgagccactctttggtgactgcggattgcagggtcaatgtatttactctttccggataatgtgaggcaaagcatatgccgctcggccctcctgctgagatggcgatcacatggacactgttgatttgtaaatgatctaataatttcacatagaaacggcaggcgttggcaagactttttccaatttcttttgacgttcgtccatagccgggccttgaaggcgtaatgatggaatacccttgctcaatcaacgctgtgtatccgaattcctcgtaacaatttgaatgcccgccatgcatgataaggatggggggaccctttccagccactgaatattctagtgtatgtccttcgaaggtgatcgtttcgactcgtcttttcatctgtttcacccaattggtttttgcctattatagagttttcagcaattgaccacaaggagaagaaatgaataaacaaaggcccttgaatatgatatactttgtattgatattcattctcaattaaaactttgatatagatgtgaacgggaggcaggacggatggctgagaatcaagaggtatatgacgttacgattataggcggggggccgattgggctgtttactgctttttactgcgggatgcgggagctgaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacgtttgatcctgatatcgtattgaatcagcgtgtgaccgggtttgaacgcctagatgaaggcaccattgttctgacgggttctgaaggggaaaagcactatacaagaactgtgattttggcttgcggcatgggtacacttgaggtcaatgagtttgacagcgaggatgcggcccgatatgcgggcaaaaatcttcattatggagtggaaaagctcgatgcgtttaaagataagcgcgtggtgatatcaggcggcggagatactgcggtcgattgggctaatgagcttgaaccgattgcggcgtctgtgactgtcgttcatcggcgtgaggaattcggcggaatggaaagcagcgtgacgaaaatgaagcaatcatcggtgcgggtgcttactccttatcggctggagcagttgaacggagatgaagagcgcatcaaaagcgtgaccgtttgtcatactgagtctagccagagggaagacatagaaattgatgagctgatcatcaatcatgggttcaaaattgatctcgggccgatgaaggagtggggactggagattgaagaaggcagggtgaaagctgacagacatatgcgaacgaatcttccgggcgtgtttgtggcgggcgacgcggctttttatgaaagcaagctgagattgattgccggcggctttaccgaaggcccgacagcagtcaacagcgctaaggcttatttggatcctaaggctgagaatatggcgatgtattccacccatcacaaaaaattggtacataaataaaacagcccttgggggaaagggctgccagccatcagctgtgaaggagctttttctgcgtctgttgattctgaatgaaagctagcaattcatcctgttcttgtacggctgtgaatccataagccccggcaactgagtcatcgcctatacagacgatagggggccggcttgctgacggttccggcaaaatgccaatttgttcgccaccattgatcaattgctgcacggacagcttgttcgggcaaatgaccatgtgcagcggggattcactgatggtacgctgaatcatgtgggtgaaccggtcatctatgacgttttcatgagtgatataaaacgaacaggattcatgctttggcatgttttccattgcatggcggctcccgacaacaagacatttctctgaatcaggctgaatggcggtgacaagaaacccccgtttttcaagctccgtctttgcttgttcagatgctgcactcagtttggctgtcagctggcggatgtcgattttctgagaagccagtgctctgaaaaattcacaaactgcccggcgcgatgtgaaaaaaacgtcttcaaaggtgccaatctttcgaagaatgtcttcattgacaggcatgttttcggtccgccatttcggccactcgatgacatcggcgccggaatcgcgcagcttgtctgcaagcgggtcttcatcttcgccatgagtcacaaccatcaaatgccgtccgatgagcggtttgctttcaaaccagctgtgtgtttgaaagttgacgatgtctccgatgacgataatcgcagggtttgtaatctggtgttcctgcactttttgctggatgttctcaagcgttcctttcacactccgctggcggccccacgttccccattggatgacaatgacagggacagaaggtgatttcccgtatgaaataagctgctggcaaatataagacaagttcttgacacccatgtaaaaaacaagggtttgtacgcttcgtgcaagcccttcccagtcaaggttcggcgtgccttttaatgatttatcatgcgctgtaatcatggcaaaagacgatgcgaaatcccgatgcgtgacggggatgcccgcatatagcggcgctgcaattccagaggtgattcccggcaccatttcatagcgaatgccgtgctcatgaagagcatctgcttcctcgccgactctgccgaatacgctcggatctccgcccttcaagcgaacgacggttaacccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttcctcgagcgcctgttttcctttgatggtgagcaggcctgggtcgccgggtccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacgcatccgtggtcaggttcttggacgattccgtcttctaaggaaattttccagtcgtgcatcgggcagaaaacatattggccgctgacgatgccttctgccaggacgccgcctttatgcggacagcggttttcgatggcgcggatgcttccgtctgaaagcttgaaaaccgcgagctccttatcttcaatatacactgttttgcctaattgttcaggcaattcttcaatttttccgatacatacttttgttacgtctttgtttaccatgcccattcctcctcaatgattgtttttgtcattatgatgtggtcacgacattttcaaataattctttcgaggtttgtttatcctctaaaaagtctttccacggatccttgtggacagagagtgtttcattcattcggtcgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaagtgggttccgccgtttccgccgacataaagctcccagcctccgtcgatgccgacaacgccaaggtccttaatgccggattccgcacagtttcgcgggcatgcagacacggccattttgactttgtgcggcgtgtttagcccttcgaattttttctcaagcgcaatgcccagtgccatggagtcttgtgtgccgaagcggcagaattgctcgcctacacatgttttcactgtgcggagcgtttttccgtatgcgtagcccgacggcatatcaagatcttcccataccttcggaaggtcttcttttttcacgccgataagatcaattcgctggccgcctgtcattttcacgagcgggatctcatatttgtcaacgacatcggcgatcttgcgcaaatctgtggagttggtcacgccgccgtacatccgaggaacgactgagtatgttccgtctttttgaatattggcgtgcattcgttcattaacaaagcgggatgtccggtcatcctcgtatttggttggattgatcatgcctaagtagtagttcagagccggccggcatttggaacagccttctggcgttttccagccgagcacattcatgacttctcttgtatgtgacagccctttggctttgatttcttctacgacttcatctcttgacaatgtggtgcagccgcaaatggcttctttttgcgctgacgcatcaaagtctgatccgagcgtatgctggaggatttcttctacgagcggcttacagcctccgcatgagcgggatgcgccggtgcatgctttgatttcgtccgttgacgagcagcccttttcctgtatggcttgaataatcgcaccttttgacacgccgttacagccgcagatgatttcatcgtcgctcatcgctgcggttatgcttgtgcctgcttcctggctgaggggctgtaagattgatattttagaggtttcagagatatcggcttctttttgaatcatagaaaacaggcgattgccttcgctgctgtcgccgaataaaacagcaccgacaatttgattgcctctcaggacgatttttttatagatgccgtcctgctcatcgaagactttaatcgcttttttctcctctgattcgttaaagtcaccggcagagaagacctcgacgcctgatacctttaactgtgtggagagaacggagccctcatacggttttgtttcgatgccgcaaatatgcttcgccagcacttttgcctgttcatagagcggtgccacaagcccgtaggcgattccgcggtgctcggcacattcgccgaccgcgtaaatgtgcgggatttcagtctgcatataatcattgacgatgatgccgcggttaaccggaatgccgctctcggcgccgagtgttgtattcggacggatgccgacagccatgacgactaaatcggcttcaatgcttgtgccatctttgaagcgaaggccttcgacacggtcatcaccgacaatttcttctgtttgcttttcaagtaaaaaggtcataccttgtttttctaactcgttttgcagcaggcgtcctgccgttgcatcaagctggcgctccatcaggaatggggcaaggtggatgacggacacgtccatgccgagattcagcagtccgcgagctgcttccaaaccaagtagtcctccgccgatgacggcagcttttttatattgttttgacgcggcgagcattgtgtctgtatcttttatgtcccggaaagctgtgacgccttttttgtctgcgcccggaatcggaaggataaaagggaccgagcctgtcgccaggatcaattcatcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggcaccgaaaattgtgatctgaaactcgtctttagcaacactcagtatctcttcaatggcccttaccccggccattccattaccaacaagaactagctgttttttttccatcagatgatccgctccttatcaatgttttttccagcgtagcacagcgaaaaggaatatttaagatacatgttataaaatgtaacaaaatatacgaaaagttctaaaaattttatgaaaaatttaaatgggtctgattcggacggtacataccttaaaaccgggcattttacaggctggatctaaggcttccccgattaaatcattcacattttgagcgtctgcccaatggatgggaacaaaaacagtatcttttctgatttgttctgataatttgctgcggacggtgatgcttccccgcggcgattctatttttaccagtacacggtcctcgatattgtaggtcgctgctgtttgcggatggatttccataaacgattcaaaatgtctcgcggcaagggcggcgctttttcttgtttggacgcctgttaagtagtgagacatgactctgcctgtcgttaaataaagcggataatcggctgtcggcttctcttttggaacaggtggttcgtttggaatcacacttaatgccgctttttgatccggatgagcaaatgattctgtaaacaagcgcccagttccgggatgatcagattccggacacggccaatgaatgccgccttcacgtctgagcctgccgtatgagatgcctgaataatcggcaatcccgcctcggctcgcttctctcaattcattaaaaatatcctccgctgacgtataagaaaagtagcggcccttgccgagagcggatgcgagatcacaaatgatctgccaatcatgctttgcttcgccggggcatggccggcttgcttctcttaatgtcacgcggccttcgacatttgtcatggtgccctcatcttctaagtaagaggaggcgggcaaaatcacatctgcgtatgtcgcagtttcagaaataaacaaatcgattgcgacaaagaatgtcagttttcttaaagcctttttcacgagatttgcatttggactggaaacagcagggttggagcacatgaggaacaatcctttgatgtcgccgtcattgattttttccatcatttcataggctgagacaccttttcgcgggagttcatcctgatggattccccacactttcgcaatatgcgcccggtgttcttcgttttcgatagaacggtagcctggaagctgatcggctttttggccatgctctctggcgccttgcccgttgccttgtccggtgatcgccccgtagcccgagtaaggtttgccgatttttcctgtgatcagcaccatgtttaagaagcctttcacagccgctgttccatcggtttgctgttcaatcccgcgggctgtaaacagcatgccggacgtttccttggcaaactttacagcagcttttcttatatccgccagcgggacactcgtctgttcggcgatgtcattcaggtccaacgagtcagtatgctgcttcagctcttcgaatccatttgttcgtgattgaatgaaatcctcgtttataagctgttcgtcgatgatgattttgacgagaccgttggcaagagcggcgtctgtgccgggtttgattttcaaatgaagatcggcgatttttgttgtcgctgtttcacgcggatcaatggcaatgaagtaagctccgttttctttcgctttttcaaaatacggcataatcgtaggctggcattccgcgatattggtgccggccagaatgatcacacgggtgtggggaatgtctgataaaggattcgttaagcctctgtctgcgccgaatgtttggttggctgcggttgctgcggcggacatacaaagcctcccgttgtagtcgatgtattttgtctgtaagcccacccgtgcgaatttccctaacaaatacgcttcttcatttgtaatcgaggcgcttccgtataccgccatggcgtcatgtccgtgttcagtttggatcattgtcacttggtctttgatatgattcagtgcttcttcccaggaaacaggcataaactcgccgtttttcttcagcagcggccgggtgatgcgggaggagttcagggcatgctggtgggcgttcatgcccttcatgcataacctgccctgtgtcgtaggattatcaatcccgatcgcagtatactttttgcgcgtgacgatggtttgttccacgagctgcattttgcactgcatactgcaaaacgggcattgagtgtcatatgttttttctgattggacgtcttgctgtttatcacggaaatatctaagcagtcgttcagtcaaaatgcctcatcctttcttatatgcacccgtctctacagtcgggttttgaatcagtgacagatctgtttggaggctttccagcagctgtgcccttaggtcttcttcgaatagcacttctctgatatgaacgatcccgagacggtctatccactgatgaacaccttctaagtaatgagccgtttcccgataatactggatcagtcctttgatcatgccggcagtgctgtcttcgttctcagtcacgcaaaacaaagctcctgaacgggcatgagttccccggacgccgccgatgtgaatgtcccagccagcttgtctccgaattgcgccgacatcttgcagggcggcatcggtgcagtctgtttcacatgataagctgatagaaatgggagcgggtaagggaagcatctcaagttgtctttcgatttgggctgccagctgctgaattgatcgattttgcccgcatgtacatgctttgatgctttgcagcgcgtgtcggtgttcattagtgtaaacgggcatcttcaggtctttttttatgttcgggagatccgcaggcttgatcccggaaagcttcagcctttggccgtgagtgatggatacgtcgggaatgctgtatgcctcaatgatgttggcgatggttcttagctgctccgcgtttgtccgcccgccgtacatttgcgggatcaggatgcatgtctcttcagtggctggctcaggctggacaaacccagggtacagcatttccagatagtattgaatcgcaggaacacaagtactgcatccgttttttgttttccagtcaagctggttcatcacttctgccggattagtgaatggcctgcgctgaagctcagcgatgatgtcgtcttctgtaaaatcagtacagctgcaaaacgaaggtgtgccggcgggcttcgtatattcgctgttggtcatgtgcctcaaaaggtcttcaacgagcggtttgcatcctccgcaggacccagtggctttggtgcagtgcttgacttcctcaacagttgttaagctattcgtgtgcaccgcttcttcaatcgcgcctttcgtcactgtgttgcattggcaaatcgtttcactggaaggcatggattcaaataaagggccgcttgtctccggttcgatgatctgctttttgacaatggagatgtctcgttgtttaaggaggctgtcgagaagccgctgcttgtcacgggtgtctccgaataaaataacgccggccagtttttcatctacaaaaagcgcttttttataaactcctgcttgttcgtcgtagattttgatgctcgtcgtgcgttcatcctcttggatctttcctgctgaccacacatcgattccagctatttttaacgccgctgatggtgctgagccttgatattcctcacatggaacgccgcaaatatgactggcgagcgcttttccctgctcataaagcggagccaccaatccgtacaccgttccgttatgctcagcgcattcaccaacggcgtagatattcggttcgcttgtctgcatgaagtcattcacgatgatcccgcggttcactttgattccggcggatacagctaattcaatattcggtctgacgccggccgccatcacaatcaagtctgcttttaatgaagagccatctttaaaatggattcggtctgccttggtggcgccggaaatggagacggtgtctttctccaaaagaaaggttaggcctttttgttccagctctgtttgcagcagccgcgccgctgtttgatcgagctgtttttgcataatgccggcggagtggtgaatgacgctgacatccataccgagatgctgtaaaccgactgaagcttccagtcctaataagccggctccgattaccgcagccttttgaaagtgctgggccatcttcatcagcgcttggcagtcttctattgtccgaaatccatagacgccttctttgtctgccccggggatagggagaatatgaggggaggagcctgttgccactattaatttgtcatacgacagagtgcgtttccgatctgtgatgacctgctgctgatctgtatcaatctgaataaccgtttcgcctgtgtaaagcgtgatcccgtgcttgtcgtaccaatccttgctgttcagtgtaatatcatcgagtgacgcttcaccctgcaatacagaggataagagaatgcgattgtaattgggatgcggctcgcttccgaaaatgacaatctcaaacatgtggcgattcagctttaatacttcttcaatacagcggattccggccaagccgtttcccgctaacaccaatctttgtttcttcatgtatcagacctcctttggcgaagctcgtaagttttctcctattaaaaattatgtcacaatgcactgttaacgcattaaacgtgtcacaaaaacttacacatgtcttttccagaaaataagggtcctatatccttgattcagaaaatgtaaaataatgagggtctagaaaggggaatcttatgaagctgtcggaactgaaaactagcggtcatccactcacgttgctctgttcctttttatactttgatgtcagttttatgatatgggttatgcttggggcgctgggtgtttatatttctcaggattttggcctgtctccttttgagaaagggcttgtcgtagctgtgccgattttatctggatctgtgtttcgtatcattcttggtattttaacggacagaatcggaccgaaaaaaacggcagtaatcgggatgctggtgacgatgattccgctgctttgggggacattcggcggccgttccctgactgagctgtatgccatcgggattctgcttggcgtggcgggggcaagctttgctgtagcgctgcctatggccagccgctggtatccgcctcatttgcagggacttgcgatggggattgccggagcggggaacagcggcacgttgtttgcaaccctgtttggccctcgtctggcggagcagttcggctggcacattgtcatgggaattgcgctaattccattattgatcgtctttattctttttgtatccatggcaaaggattcccctgcacagccgtctccccagccgctcaaaagctatctgcatgtgttcgggcaaaaggaaacatggtttttctgcctgctgtacagcgtcacatttggcggatttgtcgggctctcaagctttttatctattttctttgttgatcaataccagctgtcaaaaattcacgcaggggacttcgttacattatgtgtggcggcggggagctttttccggcctgtcgggggcttgatttcggatcgtgtcggcggcacgaaagttctttctgtactgtttgtcatcgtggcactgtgtatggccggagtcagcagcctgccatctctttcaatggttattgttctattgtttgtcggaatgatggggctcggaatgggtaacggtgcagtattccagctcgtgccgcagcgttttcgcaaagaaattggcatggttacgggaattgtcggtgcggccggaggaatcggtgggtttttcctgccgaacatcttaggatctctcaaacagatgacaggcacatatgctatcggttttatcacgttttcctgtatcgcgctgctggcgtttgcacttgtgcttgccgcaggctattactggcggaaaagctggagcgcggaaagcagcccggcggatgtgtaggtttttgacggacacgcgtttgtgcgtgtcttttttattttctcttgattttcaacagtgaaccgatcaaaataaatagtaattattacgatttgttagcgagaggagttttctgaatgaatcaacatacgctgctcccgaaaaaaacggagcgtcttcaatactttggatcggtcagtccgatcaaaggcgagaaaccagtggaaaaagagaaaatgaaggacctgcaaaatatcaggaaggattatttttttgatattcagcatgtaggtgtcgctaatgtgtcccatccagtcacaatcacttctgccatgatgcctgccgagcaaacaacggctgcgaactttacaatgacttgtaatttgccgagaaatcagaaggggattaacatgagccggttaacagagctgctgcaagtctatcatcaaaacggctggattctctcattttcctctcttcagcaatttacgaaagagcttgcagaaaacatggacatatcatctgccacagttgaagtgaggtttccgtggtttttcgaacggaaaagcccggagcttgagaaagcgggtttgatgcatgctgatatattcatgtctgtcacctatcgcatagatcagccgtttaaacagcgagccggcatctcagcaaaagtaacgactctgtgcccttgctccaaggaaatcagcgaatacagtgcccataatcagaggggaacggtcagcatttgggctgatattcatccggccgcatcgctgccaagcgattttaaagcagatttgcttcacgccgcagaatcaaatgcttctgcgagactgcatccggtattgaagcggcctgatgaaaaagccgtgacagaaacggcctatgaaaatccgagatttgttgaggatctcgtccggctgattgctgctgatttgtttgagcttgaatgggtgtcagcctttgagattgaatgccgaaatgaagaatcgatccatctccacgatgcctatgcgaagctgtgtttttcgaaggaagtggatagaatatgaaactctcattattcattattgcagttcttatgccagccagcctgctgtcagcctgctccgatcatgcagaagaacacgcaagtatcaatacaaagaaaacggtcgaaaacataacggacgttcgaaaaacagcaaaaacaagcattgattggacaaagccttcgggcggagaatacccggatattaaacagaagcatgtctggattgatgtgaatgtgaaggagcagaaggcttacatcaaggaaggaagcaacaccatctatacaatgatgatctcttctggtcttgatcaaacaaaagatgatgctacgccaaagggcaccttttatgtagagcctgaacggggagaatggtttttctccgaaggataccaggaaggcgcagaatactgggtatcatggaaaaatcacggtgaatttttatttcatagtgtgccaatgactaaggatcaaaaagtcatcaaaacggaagcagaaaaactaggaacgaaagcatctcacggatgtatcaggctgaccattccagatgcgaaatgggtatatgaaaatatccctgaacatacaaaagtggtgatcagctgaattgaaaaccgttgacaaaaaggaaaaaagaccatacaatttaaatcgtaacaattacgttttatgataaatggcttatcattgtctgtatctgtgaaaagcgtaaaggctaaggatcttgctgtcattgatccccatgaagcgtctcttgaaaactggagacgatacacaagccgcattctgatgagatatttgcgctctccatcggttcagcaacgcaagtggagcaattgctttatgcaagctgcggttttccgaatgtcggcaagggcagggatttgcgatggggaaaaggattaaacgcggttggagtctttactgatttagaaatcgggcggcagcgagaaatgagcgcgaaaagctgctctacaccattgtacatacggcgaagtattcaatttaaatcgtaatcattctattttaatggaggcactattatgaaaaaaattccggttaccgtactgagcggttatctcggtgcgggaaaaacaacattgctgaacagcattttgcaaaatcgcgaaggcttgaaaatagcggttatcgtaaacgatatgagcgaggtgaacattgacgcgggcttggttaagcaggaaggtggcctttccagaacagatgaaaagcttgtggaaatgtcaaatggctgcatttgctgcacgcttcgcgaagacttattaattgaagttgagaagctggcaaaagacggacggtttgattatatcgtcatcgaatcgacaggaatcagcgaaccgatcccggtggcccagactttctcttatatcgatgaagagatgggaatcgatcttacaaaattctgtcagctggatacgatggtgacggttgttgatgccaaccgtttttggcatgattatcagtcaggcgaaagccttctggaccgcaaagaagcattgggggaaaaggatgaaagagaaatcgccgacctcttgatcgatcaaattgagttttgcgatgtactgatcttaaataaatgtgatttggtcagcgagcaagagctcgaacagcttgaaaacgttcttcgtaaactgcagccaagagccaggttcattcgttccgtcaaaggaaatgtaaaaccgcaggagattttgcatacagggttatttaacttcgaggaagcgagcggatcggccggctggattcaagagctgacggcaggccatgcggaacacaccccggaaacagaagaatacggtatctcttcatttgtatataagagacgtttgccgtttcattctacacgattttaccgttggttggatcaaatgccaaagaacgtggtacgtgccaaaggaatcgtctggtgcgcatctcataacaacctcgctttgctgatgtcgcaagcaggtccgtcggttacgattgagcctgtatcttattgggtggcggcgttgccgaagcttgagcaggagcaagtcaaacagcaggagccggaaatcctggaggagtgggacccggagttcggcgaccgcctaacgcagctagtttttatcggaactgacctggatgaagaaacgatcacgaaagagcttgatcaatgcctgttgactgagtatgaatttgattccgactggtcgctgtttgaggacccgtttaaatggaagctgaatcaatagaaaaaaagccgtcccatggggaacggctttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagatgacgccttgattaagtcgagcaacacattggcaagcggaggcagcgcaatacgtatcgattgcggcaaaatgatgcccctcatcgtctgccaataggaaaggcccagcgaggatgcggcttcccactgtcctttttcgacggatgaaatggctgaacggttaatttccgcaatgtaggcggcgctgtttaggctaaagccgattaaagcagccgtgacagcggaaaattcaatgccgatataaggaaacccgaaataaaggataaacaaaatcaccaaaatcggaacgccccgcataaatgagatatagagcttcgccggccatcttaacaaagcaagcttagacattctggcgagtgatatgaacaggccgatcacagttcccgcaaacatgcttacaaaagagatgagcagtgtatacccaatgccttttatgacataagggaacgattcaatggccagcttcgtgttgaaaatatattcccattgaatgctattgatcatggcgtccgattacaaatcaacgtcctgaacgtcggcatcaattttttttgatacatctgctttattgaagaattgtttcgacagtttagtcaaagaaccatccttgcccatctctttcaatgcttcgttcatctttttctgaagtgccgcattgctttttttcatgacaagggcctgtttgttcggcatgtacttgatgtcaggatgaattgtaatgttgagatccgggaatgccgcgagcgcaagtgtctgcaggtaatagtcgtttaaaatgacgtcagtgcgtccattggcaacatcttttaaatattgctcattcgtcgcattatcataaatcacttctttggcgccgtattttctcgcgacctccatgtagacggttgtagccgcgccagccgctttcttcccttttaaatccttaagcgttttaatcccggataaatcgtctttacggacgattgccgtgccgtatgaatatttatatggagtagaaaatgcgaacttcttctcgcggtccttcgtcacatcgatgtcattcgcggctgcgtcaacctgtccgctgttcaccgctgtcagcatcccgtcaatgcccatctccttgaactcaaccttcaatcccaggcgttttgccgcttcacgaacgacttcaacctcgtagcctgtcagcttatcggagccagagtcggtatcatgataagaagtgggataaagcgtgcctgatgtagcgactacgattttccctttatccttaatctgctcccagcctgtatccttggaatcagcttcatttttgccggaacaggctgccaatataagaaagaaagccattgtgaaactgaatataacggctttggaatgcatgaatgatttcacctatagttcccccaatctgttaatcaactaaaaagatagcattgaacataaggggttgcaatatgttgatgacgttttcaaaaagttcgaattgtgtatacaaaaagcataggtgggtgtttaaaagcgtctatgaagggaagaggtgatgaaaaaaggagttgtccaaggatgaatgccagacgtaccaaggaaacacatgtggacgtgatggatgcagaagatcagttattcctctatgccaataccgtaagaaatggtcaagaagcatgaaatcgatcttcagaataaatttaagtcttgctgatgcccctaaggcatatgatatattcgatgagaaagaaaatggaaacatttaaaccataatgggggagtcaaatgaacatttacaaaccagccggattttggatcagacttggagctgcattgttagactacattatagtctccgtgccgcttttgctgatctattggctgattacaggaaaagacccaaacgacagcatgttcataagtttagttgttctgctgtactctattttgctgccggtgttttggcgcggctaccttatcggaaaaagaatctgcggaatcagaatcgtaaaaaagacggatcacaagtcagcctgttaacaatgtttttacgggttattgtagccggcctgttttacggtataaccttcggactcggcttgatcgccagcctgattctgattgccgtacgagaagacaaacggaccctgcatgatttaatcgcgggaacgtatgtcacttatgcgacaccaggtgaagaagaacttaatgctgacgaagagattagaaagagcgaataatggttcgctctttttatttttatgcataaaaaatacaaggcagcaaaacatatgaaaaataggattggaggaataaactggatgaaacgaataaccatcaacatcatcacaatgttcattgcagcggctgtcatttctctgaccggtacagctgaggccgctgaaaaacagcagcagcctcccgcaaatgttacactgacagatcagcaaaagaaagagattgaacaactggaagcagagattcttaaaaagcgcaaagacgtgatctcaaagtatgtacaatatggtgtcctgcctaaagaaagaggagaacacatcaaaaatcacttggacaaacactttgaaatgatgaaacaaaacggctttgttccaaagcaccattctcatccgcataaatttgaaaaaagacattaaaatggtaagcatccaatgggaattgggtgcttttttattgttaaaagttactgaatgaattttccaaaaaatatatcgcttttgttgattatatcttataataagatataaatggggtgtataatgatggagatggatttaatctctaaacttaatcagcagtggacagatatttattatttattacattatcaacataaagataatatttctcaccaggcaatacggattatgcagcatattgaaaagcaaggtgaggcgacaataggagctttggctgaatacttgtctgtctctcacaatacagcgtcagagcatactaaacgtttgattcaaaagggatttatagctaaacggcgaagtcaacaggatgaacgaaaagttttagttttcttaacacaagaaggaagatctgttcttgaacagcatacacagctagataaagagaaattaaaagaaataattgaacgaatgagcacatcagaaaagaaattacttgaacaggcatttgaacttttaagtagggaagctaaacaatggcagttttaagtaaagtaatcatctctgcgttgattatcggttttgttactgaaatatcaaaaagacatccgacctatggcggcatcattgctgctttgcccttggtcagtttattaagccttttttggatgcaaatacaaggtgaaaaaacagctcaattaagtcaatttgcatctggtgtgcttacaggaatcccagctacagtttgtttactagctattttggcttttttgctgaaaattcatgtgccgttttggtttgcattatgtgttggaatactaggatgggctatgtttttatggatgcagaagatctttctcaatatattatttaactgagtatagaaaggagatgctatgtttttaaaaaaggttactcttcttcgagataagattttggactttgacagatttccttttactatcccggctataagtcaattaaatgacatcttatttactagccaagtgactttttttgtgggggaaaatggatctggaaaatctactttgcttgaagcgatagcagataagtgtgaattcaatacagcgggcggaagccgaaataatgtctatgaattacgggagtcagattcccatttaggagattatatacgtttatcttggcttccaaaggtaacaaatggcttcttcttaagggctgaatcgttttatcatctttctcttcatctggatgagatggaactagatgctcctcagccataccgttcctatggagggaggccgctacacaatcaatcacatggagagtcctttatgtctctattccgtcatcgttttaaagagaaagcgatttaccttttagatgagccagaagcagcactttctccagctagacaattagcttttttgagagttatacatgatttggtgaagggcggaaatgtacagatgatcattgcgactcactccccaatcctactgggctatcccaatgctaatattttaagctttgatggtggaagaatacatcatattgaatatgagaatacagagcatgttcaattaacacgatattttcttggacaaagagaaaaaatattagctgagctgttccgcgactaacatcgagttgatctgaaacgcgtttcatagcctatgataggtttatcaaataattcaggagtgataaacactatgatccaccagcatccagaatcttttccgaaacattttttgtggggctctgcttctgcagcgtaccagattgaaggcgcttggaatgaagatggcaaaggcccttctgtttgggatgtgtttacgaaaataccgggcaaaacgtttaaaggaaccaatggcgacattgcggttgaccattatcaccgatttaaagaagatgtcgctctgatggctgagatggggttaaaagcgtatcgattttccgtcagctggccacggatttttccaaaaggaaaaggagagatcaatgaagcaggtctagcgttttacgatagtctgattgatgaattgctttgtcataacatcgagccggttctgactttatatcactgggatttgcctcaagcgcttatggacgattacggcgggtttgaatccagaaacatcatagaggattttaatcactactgtattactctttataaacgttttggagacagggtgaaatattgggttacgttaaacgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttacgaacaattggtggcttgacatgtattgctggggaacctacccgcaaattccattccgctacttggaaaaacagggatgggcgccgacaattgaagcaggagatatggacctgctcgccaaagggaagcctgattttgtaggtgtcaattattatcagacgatcacctatgaacgaaatccgcttgatggtgtgtcagaagggaaaatgaatacgacaggccaaaagggaaccaatcaggagacggggatacccggagtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgaggacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatccgatttaaaacgcttgaagaaaaaaagcttttattggtatcaagatgtcatcaagacaaacggagaaagtttataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttttttcgtaggagcttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcaatagtgcacacctctgagtgtccctcatttatcgcatccttaatatgcttggcagtttcgggataccggtcagatgggaaggcgattgtttcatcatattctttcgtttgagacgttttttgatcagttgaaaaaaagtctccttttatcagaccgacagctgcagctgctatgatgacgatgacgagaagtatcgtttttatgatgtccgtcgtgatgttcacctcccgcttttaaaactgacacaagagtaatccagaaagcatttggtgtaaaggtttaaattttatgttttacgctcagtttattgcagaaatcgtaattttagcagatcgaaatatttgttttcagcaaaatacgattgccaatttacaataatgatagtaagtcatcagccgttttcggcttgattaatcattttaaattggcttatgataccggtaagctcctcagctaattgagaaagtgtttcagaagctgcggtaatctcctccattgcagcaaattgctcctctgttaatgcagccgcttgccgggtatttttagtagattctttaatgtcggccgtattggctgcaaaggaatcatttatatgatgtgcactggctgaaatgtttgttacagatgctgataaatcactaatctcggcgctgatttcacctgttgcagctgcaatttccttaaatgcatctctggtgcgctggatcatggtgactccttctgcagcttctgttttcacatgctcaacagatcttgcagaccggttcatatccttttgtatttctatgatcagttttgaaatctgccccgcagactgttgagactcttccgctaatttccgtacttcatcagcaacaacagcaaagccttttccttgttcaccggctctggcagcttcaatcgctgcattcagcgcaagcaggtttgtctgatcggcaatttgggtgatgaccgataaaatttgctcaatttgtttagagcggccgtctaactggtgtatgatttctccgcttttctgaattgactggtgaatcgcatccatttgcgcctgtacatttgcaatttccttttgtccaatgtctgcttttgattgagcgagctgccctttgtcagcgatagcggcagtatttgcagaaatatcccggatgtctgctgaagcttgttttaatgagctttcactactttcaattcgggtgatctgatcttgggctccatttgcaatctgctgtacagcttctgtgattttttctgaagcttgatttgtttcctctgctccggctgagagctgctgagaggctgacgcaagctgaagggctgattgttgtacggtttgtatggtatcgttcagcttcattctcatcttattataatagacgcttagttctgaaagctcgtcaccggttttgtctgacacctctattgtcatatctccgtttccggcactttcaaaggcgctttttaaagcgttcagccgcttgttgatttttctggtgaaaaccaagacaaggatgactgatactataatgacgataacaagaacgatagcgaattgagtgaaaagtgattgtgtaagtgatgctaaaatactttgattagctccggtatacagcatgccgatgatgttcccattttgatcttttaacggcatgtatgcagtctgataagaagaacctgctacatctgcttgtccgtaaaaacgctttcctttctttaaaacagcggcaataacttcagaagaagcctgggtgccgacagctctttcgccattcttcatgacattggttgcaacacgagtatcgccttggaaaatggtaatggtatcacctgttttttcgccaagcagatcaacaatatcttcatttccattgatttgtgtttgccctttatagagcttattgtttttcacctgccagtcgcctgacatgacatcatcaatataagtgctgcttaaagcaagatcacctttcgctttttcagttgccatttgtttcatgttttctgtaatttccttaagcatcacagtgccaactgatgccgaaaacaaaagaatcaccacgaaaacgaggcaaagaattttagttcctagcttcatcttaaatcgttttatcaacataattcctccctttacgatttgtaggtcatattacttatcgggttttcgggtttaaagttttattttagaaaaaataaaaccggcctgatcttcaggccggttgtgtgatgctattcaaggtttgcgtggtgagtgaacatagtttcagaatcgagtccttttttctccatgagttttaaaatcactgcatcatagaagagcagcaaagtttgttcaaataatgatcccattggctgaatggttttatagcttccgttagactggtctttaggagaaccaggcattctgatgatgaggtccgcttgttttccgatgcttgattccggattgatggttaaagcggcaacaattccgtgtaagctttttgcttttgctgcggtatgaatcaagctttttgtctcgcctgatcctgagccgataataactagatctccttcggcgagcggcggagtgagaatctcacctacaatatgggcgttgaagcccatgtgcatcagtctcatcgcgaaggattttgccatcaggccagaccgccccgcacccgcagtgaaaatttggtgggatgaaagaatgtgatcggcaagctggtcagcctcttcattagaaatataagctgctgaacggtgtaactcattgagaatttccgctacgtattcagtcgttttcataggagttatccttggacaatcagctgcttcatttttgaagctgtttccgccttatcagctgcgcttgtaattccgcccccaacaatgacaaggtcagggttttgcttgatcacttctggcagtgtatcaagtttgatgccgcccgcgattgcggtttttgcgttttttacggtatttttgattgtcgttaattcttcgaaagagtttttgccctctgcttgaagatcatagccagtgtggacgcagatgtagtcaacaccgagtgcgtcaatttctttcgcacgggattcgatatctttcacgttaatcatgtccactaagattttcttcttttgttttttggcttcttctactgcgcctttaatcgttgcatcgtctgtagcccctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattgatgacgaccggtgttccgatttcaactacgtcgatgtattgttctacctctttgacgagctcaatggcttccgggatgttgacgaggtctaatgcaagctgtaattccattgttgatccactccctttttcgaattatttttcattctataggttccttcttttgatgagaagtaggcactttgaagtcaacaagttacttggaggatactgtgaggagagacaatcagatttctttcgcttgattttatgagtgagtataatgaaaaaagagtctgcaaaaaagtaagtaagtgatgatacgtatctaacatacaaaaaggttactaagggggggattctattgagccggatggacgacaaaaggtttaattgtgagaaggaattaacgcttgcagtgattggcggtaaatggaaaatgctcattttatggcatttaggaaaagaaggcacaaaacggttcaatgaattaaaaacattgattcctgatattacgcagaagatcctcgtgaatcagctgagagagcttgagcaggatatgattgttcacagggaagtgtatccagttgtcccgccgaaggttgaatattctctgaccccgcacggagaaagcctcatgcctattcttgaagccatgtatgagtgggggaaaggttatatggaattgattgatatcgacaaaaatgtcatgaaagaatcgttgtaagacgctcttcgcaagggtgtcttttttttgcctttttttcggtttttgcgcggtacacatagtcatgtaaagattgtaaattgcattcagcaataaaaaaagattgaacgcagcagtttggtttaaaaatttttatttttctgtaaataatgtttagtggaaatgattgcggcatcccgcaaaaatatccctgtaaataaactggaatctttcggcatcccgcatgaaacttttcacccatttttcggtgataaaaacatttttttcatttaaagtaaacggtagaaagataaaaaatattgaaaacaatgaataaatagccaaaattggtttcttattagggtggggtcttgcggtctttatccgcttatgttaaacgccgcaatgctgactgacggcagcctgctttaatagcggccatctgttttttgattggaagcactgctttttaagtgtagtactttgggctatttcggctgttagttcataagaattaaaagctgatatggataagaaagagaaaatgcgttgcacatgttcactgcttataaagattaggggaggtatgacaatatggaaataactttttatcctttaacggatgcacaaaaacgaatttggtacacagaaaaattttatcctcacacgagcatttcaaatcttgcggggattggtaagctggtttcagctgatgcgattgattatgtgcttgttgagcaggcgattcaagagtttattcgcagaaatgacgccatgcgccttcggttgcggctagatgaaaacggggagcctgtacaatatattagcgagtatcggcctgttgatataaaacatactgacactactgaagatccgaatgcgatagagtttatttcacaatggagccgggaggaaacgaaaaaacctttgccgttgtacgattgtgatttattccgtttttccttgttcaccataaaggaaaatgaagtatggttttacgcaaatgttcatcacgtgatttctgatggtatctccatgaatattctcgggaatgcgatcatgcacatttatttagaattagccagcggctcagaggcaaaagaaggaatctcgcattcatttatcgatcatgttttatctgaacaggactatgctcaatcgaagcggtttgaaaaggacaaggcgttttggaacaaacaatttgaatcggtgcctgaacttgtttccttgaaacggaatgcatccgcagggggaagtttagatgctgagaggttctctaaagatgtgcctgaagcgctacatcagcagattctgtcgttttgtgaggcgaataaagtcagtgttctttcggtatttcaatcgttgctcgccgcctatttgtacagggtcagcggccaaaatgatgttgtgacgggaacctttatgggcaaccggacaaatgcgaaagagaagcagatgcttggcatgtttgtttctacggttccgcttcggacaaacattgacggcgggcaggcgtttttagaatttgtcaaagaccggatgaaggatctcatgaagacactccgccaccaaaagtacccgtataatctcctgatcaacgatttgcgtgaaacaaagagctctctgaccaagctgtttactgtttctcttgaatatcaggtgatgcagtggcaaaaagaagaggaccttgcctttttgactgagccgattttcagcggcagcggattaaatgatgtctcgatccatgtgaaggatcgatgggatactgggaaactcaccatagattttgattaccgcactgatttattttcacgtgaagaaatcaacatgatttgtgagcgcatgattacaatgctggagaacgcgttaacgcatccagaacatacaattgatgaattaacgatgatttctgatgcggagaaagagaagctgcttgcgagggcgggcggtaaatctgtgagctaccgtaaggacatgacgatcccggaactgttccaagaaaaggctgagcagctttcagatcatccagcggttgtattcgaagatcgtacattgtcctatcgaacgttacatgagcaatctgcacgcatcgccaatgtgctgaaacagaaaggggttggcccggacagtcctgtcgcggttttgattgaacgttctgaacggatgattacagctatcatgggaattttaaaagccggcggagcctatgtgccgattgatccgggttttcctgcagagcggattcaatatattttggaggactgcggggcggacttcatcctgactgaatcgaaggttgcggcgcctgaagccgatgctgagctggttgacttagatcaggcgattgcggaaggtgcagaggaaagcctgaatgcagatgtgaacgcacggaaccttgcctacattatttacacatcgggaacaaccggacgcccgaaaggcgttatgatcgagcatcgccaggttcatcatttggttgaatctctgcagcagacgatttatcaaagcggcagccaaaccctgcggatggcattgcttgcgccgttccacttcgatgcgtcagtgaagcagatcttcgcgtcgcttcttttgggacaaaccctttatatcgtaccgaagaaaacagtgacgaacggggccgcccttgctgcatattatcggagaaacagcattgaggcgacggatggaacacctgctcatttgcaaatgctggcagcagcaggcgattttgaaggcctaaaactgaagcacatgctgatcggaggagaaggcctgtcatctgttgttgcggacaagctgctgaagctgtttaaagaagccggcacagcgccgcgtttgaccaatgtgtacgggccgactgaaacgtgcgttgacgcgtctgttcatccggttatccctgagagtgcagttcaatcagcgtatgtgccgatcgggaaagcgctggggaacaatcgcttatatattttggatcaaaaaggccggctgcagcctgaaggcgtggcgggcgagctttatatcgcgggagacggtgtgggccgaggctatttgcatttgcctgaattaacggaagaaaagtttttacaagatccattcgtgccgggcgatcgcatgtaccggaccggggatgtggtgcgctggcttccagatggaacaatcgaatatttaggcagagaggacgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctggaagcgaatttgcgccagccggtttgagggagcatgcggccagacagcttcctgactatattgtgccggcttactttacagaagtgacagaaattccgcttacgccaagcggcaaagtcgaccgccgcaagctgtttgcactagaggtgaaggctgtcagcggcactgcctatacagcgccgcgaaatgagactgaaaaagcaatcgcagccatttggcaggacgtgctgaacgttgagaaggcggggatttttgacaatttctttgaaacgggcgggcattcattgaaggccatgacccttttaacaaagattcataaggaaacaggcatcgagattccgcttcaatttttgtttgagcatccgacgattgcggctcttgcagaggaagctgatcacagagaaagccgggcattttcggtgattgaacctgctgaaaaacaggagcattacccgctttcattggcacagcagcgaacatatatcgtcagccaattcgaggatgcaggagtcggctacaacatgcctgcggcagcaattctggaagggcctttagatattcaaaagctggagcgcgcatttcaggggttaatccgacgccacgagtcattgagaacatcatttgttcttgaaaacagcacgccgagacagaacattcacgatagcgttgatttcaacatcgaaatgattgaaagaggcggccgctcagatgaggcaattatggcttcattcgttcggacatttgatttggcgaaagctccgctgttcagaatcggtttgctggggcttgaagagaaccgtcatatgctgctgtttgacatgcaccatttgatttctgacggtgtatccattggcattatgctggaggagttagcacgcatttataaaggcgaacagcttcctgatcttcgtctccagtataaggactacgctgtatggcaaagcagacaggctgctgaagggtacaagaaggaccaggcttattggaaggaagtctttgcaggcgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctttccgcttactatacgcttttgtcaaagtatacggggcaggatgacatcattgtcgggacaccgtcagcgggcagaaatcactccgatacagagggcattatcgggatgttcgtcaatacgcttgcgattcgcagtgaggtgaagcaggatgagacgtttacccaattgatctcgcgtgtccgcaaacgggtgctggatgccttttctcatcaggactatccgtttgagtggcttgttgaagatttgaacatcccgcgtgatgttagcaggcatccgctgtttgacacgatgttcagccttcaaaacgcgacagagggcattccggctgtcggcgatctttccttgtctgttcatgagaccaatttcaagattgccaaatttgatttgacggtgcaggcgagagaaaccgatgaaggcattgagcttgatttggattacagcacgaagctgtttaaacaaagcacggcagacaggctgcttacgcattttgcgcgattgcttgaagatgctgcggctgatccggagaagccgatttctgagtataagcttctttctgaagaggaggctgcttcgcaaattcaacagtttaacccgggcagaacaccttatccgaaagacaaaacaattgttcagctgtttgaggagcaagcggcgaatacgccagaccacactgcgcttcaatatgaaggcgaatcactcacttatcgtgaactgaatgaacgggccaatcgtttagcccgcggcattctttctcttggagctggcgaaggcagaactgcggctgtcttatgcgagcggtcaatggatatgattgtgtcgatcttggcagtattaaaatcaggttcggcttatgttccgatcgatccggaacatccgattcagcggatgcagcatttcttccgtgacagcggagcaaaggtgcttctcactcagaggaaattaaaggctttggcggaagaagcggaatttaagggcgttatcgtgctagccgatgaggaagaaagctatcatgccgatgcgcgaaatctcgcactgcctcttgattctgcagcaatggccaacctgacgtatacttctggaacgactggaacacctaaggggaatatcgtgactcatgccaatattctccgcacggtgaaggaaacgaattatctcagcattacagaacaggatacgattctcggtctttccaattacgtgtttgacgcgtttatgttcgatatgttcggctctttgttaaacggagccaagctggtgctgataccgaaggaaaccgttttggacatggctcgcctgtcccgcgtcattgaacgggagaacatcagcattctcatgattacaaccgctttgttccacttgcttgtggacttgaatccggcatgcttgtcaacgcttcgcaagattatgtttggcggggaacgggcttcggttgagcatgtcagaaaagctttgcaaacggttggaaagggcaagcttcttcacatgtatgggccgtctgaaagcacggttttcgcgacgtatcatccggttgatgaattggaggagcacactctgtctgttccgattggaaaaccggttagcaatacggaagtatacattcttgaccgtacgggacacgtgcagcctgccgggattgccggagagctttgcgtcagcggcgaaggtctcgtgaaaggctattacaaccgtccagaactgactgaggagaaatttgttccccatccgtttacatccggcgaacgcatgtataaaacgggagaccttgcgagatggctgccgaatggcgacatcgaatttatcgggcgaatcgaccatcaggtgaagattcgcggacagcgcatcgagcttggagaaatcgaacatcagctgcaaacccatgatcgtgttcaggaaagtgttgtgcttgccgttgatcaaggagcgggagataaactgttgtgtgcttactatgtcggagagggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatggaacggaacaaaaagtcgcggacatttgggcacaggtacttcaggcagaacaagtcggcgcttatgaccacttctttgacattggcggacattcattagcaggcatgaagatgcttgccttggttcatcaggaactgggcgttgagctgtcactcaaggatctcttccagtcaccgacggttgagggcttggcacaggtgattgcctccgctgaaaaagggacagccgcaagtatcagcccggcagagaaacaagatacgtatcctgtttcttcaccgcaaaaacggatgtacgtgcttcagcagcttgaggatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaaaaggctgagtgtgagatagcctatttcgaagccccggaagaagagatagagcggatcgtttctgagtttattaagcctttcaaaatcgaccaacttccactgttcagaatagggcttatcaagcattcagacactgagcatgtgctgctgttcgatatgcatcatattatttctgatggtgcatctgtcggtgtgctgattgaggagctttcaaagctgtacgacggagaaacccttgagccgctccgtattcaatataaggattatgccgtgtggcagcagcagttcattcagtctgagctttacaagaagcaagaagagcattggctgaaggagctggacggagagctgccggtgctgacgcttccgaccgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtggccggacgatctcaagcggacgtcagccgcgtcatcggaatgttcgtcaatacattagcgttgcgcacgtatccgaagggtgaaaagacgtttgctgactatcttaacgaagtgaaagaaacggcactcagcgcttttgatgcgcaggattacccacttgaggatttgatcggaaatgttcaggttcagcgtgacacaagcagaaatccgttattcgatgcagttttttcaatgcaaaatgcgaatataaaggatttaacaatgaaagggattcagcttgagccgcatccgtttgaacggaaaacagccaagtttgacctcacgctgacggctgacgaaaccgacggagggcttacattcgtactcgaatacaatacagctctgtttaagcaggaaacgattgaacgatggaagcaatattggatggagcttttagatgcagttactgggaacccgaaccagccgctttccagcctgtcactggtcactgagacagaaaagcaagcgcttcttgaggcatggaagggcaaagcgctgtctgtgccgacagacaaaacggttcatcagctattcgaagagactgtccagtgccacaaagaccgcccggctgtcacatacaacggccagtcttggacgtacggcgagctgaatgcgaaggcaaaccgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagctcctcttgaaacaggaaggcatttcagtgccggacagctatacgggagatgtcattcttctcgacggaagccgcacgattctaagcctgccgcttgatgaaaacgacgagggaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagtagaggaccgcagtgcgaagtacgcgggctttgggttcgacgcttccatttgggagatgttcccgacctggacgatcggtgctgaacttcacgtcattgatgaagcgatccgcctcgatatcgtccgcctgaacgattacttcgaaacgaacggcgtaacgatcacgttcctgccgacacagcttgcggaacagttcatggagcttgagaacacatcacttcgcgtattgctcactggaggagacaagctgaagcgggcagtgaaaaagccgtacacactcgtcaacaactacgggccgacagaaaatacggtcgttgccacgagtacagaaatccatccggaggaaggctcgctttccatcggaagggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctttcagaaattgaagtccagctcgcccagctttctgaggtgcaggatgcggcggtgacagctgtcaaggataaaggcggcaatacagcgatcgcggcgtatgtcaccccggaatcagctgatatagaagcactaaaatcaacactaaaggaaaccctgccggattacatgatcccggtgttctgggtgacgctgaacgagcttccggttacggcaaacggcaaagtcgaccgcaaagccttgcctgagccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaatcagcacggctggaagctggaaatgaaagatctcttccagcatccgacgatcgaagagcttacccaatatgtagagcgtgccgaaggcaaacaggcagaccaaggcccggtggagggcgaagtcatcctgacgccgatccagcgctggttctttgaaaagaacttcacgaacaagcaccactggaaccaatcggtgatgctttacgccaagaagggctttgatcctgaacgagtggagaaaacattgcaggcgctgatcgagcatcatgacgcgctccgtatggtctatcgtgagggacaggaagacgtcattcaatacaacagaggtcttgaagctgcttccgctcaattggaggtcatccagattgagggccaagctgcagattacgaagaccgtatagagagagaagcggagcgtttgcaaagcagcatcgacttgcaggaaggcggcttgttaaaagcaggattgttccaagcggaagacggagaccacttgcttcttgccattcaccacttagtggttgacggcgtgtcgtggcggattttactggaggatttcgccgcggtatatacacagcttgagcaaggcaatgaaccggttctcccgcagaaaacacattcatttgcagagtatgcagagagattgcaagacttcgcgaactccaaagcctttttgaaagaaaaagagtattggagacagcttgaagaacaagctgttgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaagatcgagtaagtgttcatttagaggggcatggacgtgaagaaatcatagaagacctgaccatttctcgcacagtcggctggtttacaagtatgtacccaatggtgctcgatatgaagcatgcggatgatctgggctaccagctgaagcaaatgaaagaagatatcagacatgtgccgaataagggagtcggatacagcattctgcgctatctgacggcaccggaacataaagaagatgtggcgttctcgattcagccggatgtcagcttcaactatttaggtcagtttgacgaaatgtcggatgcaggtttgtttacgagatcagagctgccatcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccaatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaaccgccagaaagagcacattgagcgttacaaacaagacgttcagcgccaaggctttaacctggcaaaagacatattgttcaaggtagcggttttccgccttgatgcagatcagctgtatcttgtctggagcaatcatcatattatgatggacggctggagcatgggcgtcctcatgaaaagcctgttccaaaactatgaagcgctcagagcaggaaggacacctgcaaacggtcaaggcaagccttactccgactacatcaaatggcttggaaaacaggacaatgaagaagcggagagctactggagcgagcgcttggcgggttttgaacagccaagcgtgctcccgggccgcctgcctgtaaaaaaagacgaatacgtcaataaagaatattcctttacatgggacgaaacactggttgcccgcattcagaaaaccgcaaaccttcatcaagtgacagggcctaacctatttcaggccgtttgggggattgttctcagcaaatacaactttacggatgatgtgatcttcggaacggtcgtctcgggacgaccgtctgaaatcaacggaatcgaaacgatggcggggctgtttatcaacaccattccagtgcgggtgaaagttgaacgagatgctgcattcgctgatattttcacagctgttcagcagcatgcagtagaggcagagcgttacgattacgtgccgctctatgagattcaaaaacgctcagctcttgatggcaatctcttaaaccatctggtcgcgtttgaaaattatccgcttgatcaagagcttgaaaacggcagcatggaagaccgcctcgggttttcaattaaggtagaaagcgcatttgaacaaacgagcttcgatttcaacctgattgtgtatccaggcaaaacatggaccgtcaaaattaaatataacggagccgcctttgattccgcttttatcgaacggacagcggagcaccttaccagcatgatggaagcagctgtcgctcagccggccgcttttgtgcgtgagtacgggcttgtgggagacgaagagcagcgtcaaattgtcgaggtgtttaacagcacgaaagccgaactccctgaaggaatggctattcatcaggtgtttgaagagcaagcaaaacggacgccggcgagcactgccgtcgtatatgaaggaaccgagctgacgtaccgcgagctgaatgcagcggccaaccgtctggcgagaaagcttgtcgaacaaggtcttcaaaaaggggaaacagcagcgattatgaacgaccgctcagtagaaaccgttgtcggcatgctggctgtgttaaaagcaggtgccgtatatgtgccgcttgatccagcgcttccgggggatcgtcttcgtttcatggcagaggacagctccgttcgaatggttttgatcggaaattcttatacagggcaggcacatcagctgcaagtgccggttcttacactggacataggctttgaagagagcgaagcggctgacaatctcaacctgccatccgccccttctgatttggcgtacatcatgtacacatccggttcaacgggcaaaccgaaaggcgtcatgatcgaacataaaagcattctgcgcctcgtcaaaaatgccgggtacgttcctgttactgaagaggaccgcatggcgcaaacgggagctgtcagctttgatgccggaacgtttgaggtattcggcgcactgctgaatggcgcagcgctttatccggtcaaaaaagagacgctgcttgatgcgaaacaatttgctgcatttctgcgtgagcaaagaatctcgacgatgtggctgacatcacctttattcaaccagcttgctgcaaaggatgcgggtatgttcggcacactgcgccatttaatcatcggcggagatgcccttgtcccgcatattgtcagcaaagtaaaacaggcatcgccgtcgctttcattgtggaacggatacggcccgacagaaaacacgacgttttcaaccagttttctgatcgaccgtgagtatgggggctctatcccaatcgggaagccgatcggaaattccactgcctacatcctggatgagcagcaatgcctgcagccaatcggcgcgcctggtgagctttgcgtaggcggaatcggtgtagcgcgtgggtatgtcaatctccctgagctgacagaaaagcaatttctcgaagacccgttcagaccgggtgagagaatttatcgcactggtgacttggcaagatggctgccggacggcaatatcgaatttttaggcagaatcgacaaccaagtgaaggtgcgcggcttccgaattgagcttggcgaaattgaaacaaaactgaacatggctgagcatgtgacagaggctgcggtgatcatccgcaagaacaaagcggatgaaaatgaaatttgcgcgtactttacggcggatcgtgaagtggctgtgggcgagctgagaaaaacactgtctcagtctttgcctgactatatggtccctgcccacctgattcaaatggacaacctgccgctcacgccaaacgggaaaatcaataaaaaggaactgcctgcaccgcaatcagaagccgtgcagccggaatacgcagcaccagaaacagagagtgaaaagaaattagcggagatctgggaaggaatactcggcgtcagagcaggcgttaccgataacttctttatgatcggcggccattctttgaaagcgatgatgatgacggcgaaaattcaagagcattttcataaggaagttccgataaaagtgctttttgaaaagccgactattcaagaaatggcactgtatttggaagagaacgaaagcaaggaggagcagacgtttgaaccgatcaggcaagcatcttatcagcagcattatcctgtatccccggcccagcggagaatgtatatcctcaatcagcttggacaagcaaacacaagctacaacgtccccgctgtacttctgctggagggagaagtagataaagaccggcttgaaaacgcgattcagcaattaatcaaccggcacgaaatcctccgtacatcgtttgacatgatcgacggagaggttgtgcaaaccgttcataaaaacatatcgttccagctggaggctgccaagggacgggaagaagacgcggaagagataatcaaagcatttgttcagccgtttgaattaaaccgcgcgccactcgtccgttcgaagcttgtccagctggaagaaaaacgccatctgctgctcattgatatgcatcatattattactgacggaagttcaacaggcattctaatcggtgatcttgccaaaatatatcaaggcgcagatatggaactgccacaaattcactataaagattacgcagtttggcacaaagaacaaactaattatcaaaaagatgaggaatattggctcgatgtctttaaaggcgaactgccaatactggatcttcccgcggatttcgagcggcctgctgaacggagctttgcgggagagcgcgtgatgtttgggcttgataagcaaatcacggctcaaatcaaatcgctcatggcagaaacagatacgacaatgtacatgtttttgctggcggcgttcaatgtactcctttccaagtacgcgtcacaggatgatatcattgtcggctcgccgacagctggcagaacacatcctgatctgcaaggtgtgccgggtatgtttgtcaacacggtggcactcagaacggcaccagcgggagataaaaccttcgcgcaatttcttgaagaggtcaaaacagccagccttcaagcattcgagcaccagagctatccgcttgaggagttgattgaaaagcttccgcttacaagggatacaagcagaagtccgctgttcagcgtgatgttcaacatgcagaatatggagattccttcattaagattaggagatttgaagatttcctcgtattccatgcttcatcatgttgcgaaatttgatctttccttggaggcggtcgagcgtgaagaggatatcggcctaagctttgactatgcgactgccttgtttaaggacgagacgatccgccgctggagccgccactttgtcaatatcatcaaagcggccgcggctaatccaaacgttcggctgtctgatgtagatctgctttcatctgcagaaacggctgctttgctagaagaaagacatatgactcaaattaccgaagcaacctttgccgctctttttgaaaaacaggcccagcaaacacctgaccatcctgcggtgaaggctggcggaaatctgctgacctatcgcgagcttgatgaacaggcgaaccagctggcgcatcatcttcgtgcccaaggggccggaaatgaagacatcgtcgcgattgttatggaccggtcagctgaagtcatggtatccattctcggtgtcatgaaggcgggggcagctttccttccgattgatcctgagacacctgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttccgggtctcgcaatcttgcatacgtcatttatacgtccggtacgaccggaaagccaaagggcgtgcagattgagcatcgcaatctgacaaactatgtctcttggtttagtgaagaggcgagcctgacggaaaatgataagactgtattgctttcatcttacgcatttgaccttggctatacgagcatgttccctgtacttctgggcgggggcgagctccatatcgtccagaaggaaacctatacggcgccggatgaaatagcgcactatatcaaggagcatgggatcacatatatcaaactgacaccgtctctgttccatacaatagtgaacacctccagttttgcaaaagatgcgaactttgaatccttgcgcttgatcgtcttgggaggagaaaaaatcatcccgactgatgttctcgccttccgtaagatgtatggacataccgaatttatcaatcactacggcccgacagaagcaacgatcggcgccatcgccgggcgggttgatctgtctgatcctgatacatttgtgaaacgcccgacaatcggacggccgattgcgaatgccggcgcgcttgtcttaaatgaagcattgaagcttgtgccgccgggagcgagcggacagctctatatcacgggacaggggcttgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgcggctaccgcattgagccgaaagaaattgaaacggtcatgctcagcctcagcggaattcaagaagcggttgtattagcggtttccgagggcggtcttcaagagctttgcgcgtattatacgtcggatcaagctattgaaaaagcagagctccggaagcaactttccctaacactgccgtctcatatgattcctgctttctttgtgcaggttgacgcgattccgctgacggcaaacggaaaaaccgacagaaacgctttgccgaagccgaacgcggcacaatccggaggcaaggccttggccgtaccggagacagcgcttgaagaaagcttatgccgcatttggcagaaaacgcttggcatagaagccatcggcattgacgacaattttttcgatttaggcggccattcattaaaagggatgatgctgattgccaacattcaggcggaattggagaaaagcgtaccgcttaaagcactgttcgagcagccgactgttcgacagctggcggcttatatggaggcgtctgccgtttcaggcggtcatcaagtactcaagccggctgacaagcaggatatgtatccattgtcatccgcacagaaacggatgtacgtgctcaatcagcttgaccgccagacgataagctacaacatgccatctgttcttctaatggaaggagagcttgatatttcgcgcctgcgcgactcactcaatcagctcgtgaaccgtcacgaatcattgcggacgtcatttatggaagctaatggtgagcctgttcagcgcatcattgagagggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatctttgtaaaagaattggcgctgctttacaaaggagagcagcttccggagccggcgcttcattataaagatttcgccgtttggcaaaatgaagctgagcaacaagaacggatgaaggagcatgaggcgtactggatgtcagttctttcaggcgagctgccagagcttgatctcccgcttgattatgcccgtccgcctgtgcaaagctttaaaggagatacgatccgtttccgtacgggaagtgagacggcaaaggcggtagaaaaactgcttgccgaaaccggaacgaccttgcacatggtgctccatgctgttttccacgtctttttaagcaaaatttccggacagcgggatatcgtcatcggctccgttactgccggccggacgaatgctgatgttcaggacatgccgggaatgttcgtcaatacacttgccctgagaatggaagcgaaagaacagcaaacatttgcggagcttttggagcaagcaaagcagacgaacttgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctggaatatgcgacagatctgttcgcaaaagaaacagctgaaaaatggagcgaatacgttctgcggctactaaaggctgttgcggataacccgaaccagccgctttccagcctgtcactggtcaccgagacagaaaagcaagcgcttcttcaggcatggaagggcaaagcgctgcctgtgccgacagacaaaacggttcatcagctattcgaagagactgcccagcgccacaaagcccgcccggctgtcacatacaacggccagtcttggacgtacggcgagctgaatgcgaaggcaaaccgtctcgcgcggattctgatggactgcggcatcagcccggatgaccgcgtcggcgttctcacgaagccgtcgcttgaaatgtccgccgcggtgctcagcgtcttgaaagccggaggggcgtttgtgccgattgatcctgactacccggatcagcggattgagtatattttacaggacagcggcgcgaagcttctcttgaaacaggaaggcatttcagtgccggacagctatacgggagatgtcattcttctcgacggaagccgcacgattctaagcctgccgcttgatgaaaacgacgaggaaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggctttgggttcgatgcttccatttgggagatgttcccgacttggacgatcggcgctgaacttcacgtcattaatgaagcgatccgcctcgatatcatccgcctgaacgattacttcgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaacaactacgggccgacagaaaatacggtcgttgccacaagcgcagaaatccatccggaggaaggctcgctttccatcggacgggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgagcgcatgtaccgcaccggcgatttggtgaagtggacaggcggcggcatcgaatacatcggccggatcgaccagcaggtcaaggtccgcggctaccggatcgagctctcagaaatcgaagtccagctcgcccagctttctgaggtgcaggatgcggcggtgacagctgtcaaagataaaggtggcaacacagcgatcgcggcgtatgtcaccccggaatcagctgacatagaagcactgaaatcagcactgaaggaaaccctgccggattacatgatcccggcgttctgggtgacgctgaacgagcttccggttacggcaaacggcaaagtggaccgcaaagccttgcctgagccggacattgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaagctggaaatgaaagatctcttccagcatccgacgatcgaagagctgacccaatatgtagagcgtgccgaaggcaaacaggcagaccaaggcccggtagagggcgaagtcatcctgacgccgatccagcgctggttctttgaaaagaacttcacgaacaagcaccactggaaccaatctgtgatgcttcacgccaagaagggctttgatcctgaacgggtggagaaaacattgcaggcgctgatcgagcatcatgacgcgctccgcatggtctatcgtgaggaaaacggggacatcgttcaggcgtataaaccgatcggtgagagcaaggtcagcttcgaaatcgtggatctgtacggctctgatgaagagatgctgagaagccagattaagattctcgcgaacaagctgcaaagcagtctcgatctgagaaccgggccgcttttaaaggcggagcaatatcgcacagaagctggggatcacctgctcattgctgtacaccatctcgtggtcgacggtgtgtcatggcggattttgcttgaagactttgcttcaggctacatgcaggctgagaaagaagagagccttgtcttcccgcaaaaaacaaactccttcaaggactgggcggaagaactggcggcattcagccaatcagcgcatcttttacagcaggctgaatactggtcgcaaattgccgctgaacaggtttctcctttaccgaaggattgtgaaacagagcagcggatcgtcaaggatacatcatccgtcctatgtgaattaacggaagaagacactaagcatcttttaacagatgttcatcagccatatggaactgaaatcaacgatattcttctcagtgcgctcggtttgacaatgaaagaatggacaaagggtgccaaaatcggcattaaccttgagggacacggccgggaggacattatcccgaatgtgaatatctccagaacggtcggctggtttacggcacaataccctgttgtgctcgacatatctgacgcagatgcctcggctgtgatcaaaacagtcaaagaaaacctgcgccgcattcccgacaaaggtgttggctacggcattcttcgttatttcacagaaacagcggaaacaaagggcttcacaccggagatcagcttcaactatttgggccaattcgacagtgaagtcaaaaccgatttctttgaaccatccgctttcgatatggggcgccaagtaagcggagaatcagaggcgctgtacgctttaagcttcagcggcatgatcagaaacggccagtttgtgctttcctgctcctacaatgagaaggagtttgaaagagctacagtcgaggagcaaatggaacggtttaaagaaaacctcctgatgctaatccgccattgcacggaaaaagaagacaaggaattcacaccaagcgacttcagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaagacctgtccaagtcgtattgaaaaaacggcagttccaaatagaagaaatcgatctgacacacttaacgggcagcgagcaaacagccaaaatcaatgagtacaaagaacaggataagatcaagggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagcctgccgcccgtcaaaccgtataaagactacatcaagtggcttgaaaagcaggataaacaagcatcgctccgctactggcgcgagtacttggaggactttgaaggacaaacgacgtttgcggagcaaaggaagaaacagaaggacggctatgagccgaaagagctgctcttttcactgccggaggcggaaacaaaggcttttactgagcttgcaaaatcgcagcataccactttaagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacgacttgctcaagcagctgcaggagcaatcgctgcagtctgagccgcaccaatatgtgccgctttatgacatccaaagccaggccgatcagccgaaactgattgaccacatcattgtttttgagaactatccgcttcaggatgcgaaaaatgaagaaagcagtgaaaacggctttgatatggtggatgttcatgtttttgagaagtcgaattatgatctcaacctgatggcttccccgggagatgagatgctgattaagcttgcctataatgagaatgtgtttgatgaggcgtttatcctgcgcttgaaatctcagcttctcacagcaattcagcagctcatccagaatccggatcagcctgtcagcacgatcaacatcgttgacgacagggagagagaatttttgctaaccggcttaaacccgccggctcaagctcatgaaacaaagcctctgacggattggttcaaggaagcagtgaacgtcaatccggatgcaccggcgcttacgtattccggccagaccctgtcttatcgcgaattagatgaggaagcgaaccgccttggacgccggctgcaaaaacaaggtgcgggcaaaggctctgttgtagcgctgtacacgaagcgctcacttgaactggtgatcggcattctcggtgtattaaaggcgggagcagcctatctgccggttgatccgaagctgccagaggaccgaatctcgtatatgctggctgacagtgcggcagcctgtcttctgacgcatcaggagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatcaccactcatgccaatattcaaggattggtcaagcatgtagactacatggcattctctgagaaagatacattcttgtctgtttcgaattacgcctttgacgcatttacttttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacagatgcgggagaggattggatgaagggactacgctgtatattattcggcggagagcgcgcctcagtgcctcatgtcagaaaagcgctgcgggtcatggggccgggcaagctgattaactgctacgggccgactgagggaacagtgtttgcgactgctcacgtcgtgcatgatataccggattccatctcctcattgccgattggaaagccgatcagcaatgccagtgtttatattctgaatgagcaaagccagctccagccattcggggcgatcggtgaactgtgcatcagcggaatgggcgtgtcaaaagggtatgtaaatcgtgctgacctcacgaaggaaaagtttattaagaacccgttcaagccgggagaaacgctttaccgcacaggggatttagcgcgctggctgccggatggaacgattgaatacgccggccgtattgacgaccaggtcaaaatacgcggacaccggattgagcttgaagaaatcgaaaagcagctgcaggaatacccaggtgtgaaagatgcggtcgttgtggcggaccgccctgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggatcggaccgcggaacgagatggaagaaacaatcgcacaaatatggtctgaggttctcggcagaaagcaaattggcattcatgacgatttctttgcgctcggagggcattccttgaaggccatgaccgccgcttcccgcatcaagaaagagctcgggattgatcttccagtaaagcttttgtttgaagcgccgacgatcgccggcatttcagcgtatttgaaaaacgggggccctgatggcttgcaggatgtaacgataatgaatcaggatcaggagcagatcattttcgcattcccgccggtcttgggctatggccttatgtaccaaaatctgtccagccgcttgccgtcatacaagctgtgcgcctttgattttattgaggaggaagaccggcttgaccgctatgcggatttgatccagaagctgcagccggaagggcctttaacattgtttggatattcagcgggatgcagcctggcgtttgaagctgcgaaaaagcttgaggaacaaggccgtattgttcagcggatcatcatggtggattcctataaaaaacaaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcagcctgatcagcacaggccaggtgaaagcagatattgatctgttgacttccggcactgattttgacatgccggaatggcttgcatcatgggaagaagctacaacaggtgcttaccgtgtgaaaagaggcttcggaacacacgcagaaatgctgcagggcgaaacgctagataggaatgccgggattttgctcgaatttcttaatacacaaaccgtatcggtttcataaatgaagtgatgaaaggaggagacagccaatgagccaactcttcaaatcatttgatgcgtcggaaaaaacgcagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggtggaatgatcaccttcaggctggcgcaaaagcttgagcgtgaaggcgtctttccgcaggcggttatcatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattaccgggctcttgaacaatttgagcttttcgatctggcccagatccagtcgcctgttcatgtctttaacgggcttgatgataaaaaatgcatacgagatgcggaaggctggaagaagtgggcaaaagacatcacattccatcaatttgacggcgggcacatgttcctgctgtcacaaacggaagaagtcgcagaacggatttttgcgatcttgaatcagcatccgatcattcaaccgtgatcaaaagcggacagcttcggctgttccgcttttttttgtgttgaatgccaatttttgcatggtataatagtcgaaatactcaaataaaggaaggtcgaaacatgcgcacgtctcccaggatgaaatggtttgtattgctgtttacgtttgttttcgccatcggaatgaactcattcagaaattcctttcaattttttatgctgccaatggcagatgccttccatgccgacaggtcgctgatttcggtttctgtcagcatttttatgatcacaaccggcatcgtccagttttttgtcggtttttttatcgaccgtttcagtgtcagaaaaattatggcgcttggagctgtctgcatcagcgcaagctttttggtgcttccttattcaccgaatgttcatgtgttttccgccatttacggtgtgcttggcggaatcggctattcctgcgcggtcggcgtgacgacccagtatttcatcagccgttggtttgacacacacaaaggtctggcgcttgctattttgaccaatgccaactctgcgggcctgctgcttctctcgcccatttgggctgcggctccgtatcatgccggctggcagagcacctataccattttgggaatcgtcatggcggctgttctgctgccgctcctcgtctttgggatgaagcacccgccacatgcgcaagcggagtctgtgaaaaaatcttatgattggcgggggttttggaacgtgatgaagcaatcccgcctcattcatatcctgtacttcggcgtgtttacttgcggatttacaatgggaattattgatgctcacctcgtcccgatactgaaggatgcgcatgtctctcatatcaacggaatgatggccgcgtttggggcgtttatcatcattggcggattattggcaggctggctgtccgatctcctcggcagcagaagcgtcatgctatccatcttatttttcattcggctgctcagcctcatttgcctgctcattcccattctcggaattcatcacagcgacctttggtacttcgggtttatcctgttattcgggctcagttacacaggcgtgatcccgctgaccgcagcgtcaatttcggaaagctatcaaacaggattgatcggatcgctgttaggcatcaatttctttatccatcaggttgccggagctcttagcgtgtatgcgggcggtttgttttttgacatgactcatggttatttgctgattgtcgctgtgtgcatcgtgtttgtgggtttatcggctgtaatagagctggtgccgtttttagataaacagaaggcaaaagaaacccaccattcaatataaaaggatcagcactgtcaatgctgatcctttttaaatttgagtttttttgtttcggtatttttaaggataatctccttgaatctgttcatttcctctttggaatgaaaaaaacgttttgggatcgcaatatattggccacttgatgtattgaccctgaagatatttttatattcgaaaacagctgtgatttcatcccaattgtaaatgaggtcatattttttagaacatatacgaattccttcttggttcagagtatatgttcttttagatttcatccgttcgttcttcttgtatgctctggaaaacttcacatatagaagaaggaggagcagcagtgtaaacagaactgacatcacgataatcaacatactgttcataaacaagttaagcgcgtcactgccataaacgatacggggccatccgttaatgaagttaactgcagcaaatatggcgcaaaacaacagaaagtaaaagcatgatatttttgcgatttgataaaaaaagatttctcttacatccttaaaagcgatttctcctggaagattgatactttcattagcatattgaatcatacggtaaacctacacctctaaccatgtttttcctttcagtctagcataatttctcatttttttgcaggcataccagggcgctttgtttttttctccagattgatattgctccccaccacgccaatcataatacaaacagccccggcaagatgataccaggccaggctttcgttgagaatcacaactcctgcaatcatcgtcacaatggtagatacatgattaaaagcgctcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgatccgtgacgcacaagggcgatggcgttgaagacgacaaagccgatggctgacatgatgtaggtgagctcggtcagcttgaaccgctgcgtcatttttctggcagcagtattgtacatcgctgaggacaaagcggacaataggatcagcaaagacccttttaagctggctgattccacgtcaacgcctttcatcacaaaaataaacatgacgccggcaacggataaaactgtgaatcccttttgcgtccacgttgggcgttcctttaaaacataagcggcaaagaccatcgtgaaaatcggaatggctgcctgaataattcccgcttcagaggaggacgagtacacaaggccgaatgcctgaaagctgaaaaataacgcgggatacagcagggcgagcggcaaaatggcaatgacgtcctttatgcggattgatagctttacccagccgaataagatcgatatagtggccgcagcaaacgcaatggtgaaccgatgcgccaaaatatcaaacggctctgctgtttgcagtgcgatttttacgaatagaaaggataaaccgataatgaacgaatataaaatagccgctatataagcgggggcttgctgatgtttaaccataatgggaagtccctttattgtatggccgcggtcagaacggtacaatgagaaaaacaatgaactgtaccggtacaaaacagggggagaaggcatggagaaatatatgagtctattaatgaggatagaggagatgatgcaaagcaccgcctatcaagaaggagacaggcttccatctatccgtcagctgtccgcccgctaccaagtcagcaaaagcacagtgatccgcgcgctgcaggagctggaaaagcgccaccttatctattctgttccgaaaagcggctattatattgtgaaaaagacagggaaatcaaaaagcgggcagcctggccccatcgactttgccacatctgcgccggatccagatgtgtttccgtatcttgattttcagcactgtatcaacaaagcgattgatacatacaaaaacgatttgtttatttatgggacgccaaaggggcttccatcactcatccgcgtactccgaaagctcttggccactcaacaggtatttgcggatgaacggcatattttcattacatcaggtgtccagcaggcgttatccttgctttgtgccatgccgttcccaaatgggaaagagaagattgccattgaacagccgggctaccatttgatggtcgaacagcttgagacgcttgggattcccgctatcggggtgaaacgaacggaagaagggcttgatatagccgaggttgagcggttatttcaaacagaatcgattaaatttttttatacgatgccccgcttccataacccgcttggctgctctttgtcagagcgtgataaacaggagcttgtgagactggcagaagcgtatgatgtctacctcgttgaggatgattacctcggtgatctggaggaaaataaaaaggcagatccgctgtacgcatatgatctgtcctcacatgtcatctatttgaaaagcttctcgaaaatgatgttccccggcctccgcgtgggggcggctgttttgcccgaagcgctgactgacacgttctatgcgtacaaaaagctgaacgacatcgactgttcgatgatttctcaagcggcattggagatttacctgaaaagcggtatgtacggcaggcataaggagaaaatcagagattcttataaagagcggtcgctgaggctacatcaagccattcgaactcacaggcagctgggaagcggacgctttacgttctccagcgggcaggcaccctgtatgcacacccatctggtgcttcctcaggatctgcccgcctcaagagtgattcatagactggaaaaacaaggggttctccttgaggcgatagaccgtcattatttatcagattatccgaaagaaaatctattaaaaatcaatatttccaatgtgaaaacggaaaatattgagcgcggtgtcaagctgttgatgagccatttataaaagctcttcgtacgagaccattgtgatatcctcggggaaatcagggtgtgcggcgcatacagccattttgtagccgggatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaaggctgatcggtttcgttttttcgatatctatgccgatcggctgtgaatcaaacgcgcaaatgacccagcgtccggagtgagaaatgttgaaatgagcgtcgggaagatcagggatgcacggcttcccgtattcctgcgtgctaaagcggatatcggatttgtccaactgatactgcctgcttatgactgagcgaacgagcacatctcccagcagggtgcggtgagcatcttctttatgataaaatctccggcatttctcccgtttttcaggtgctatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtggacaggcggagatgctttcacagcggctgtccgccttgccacagcataattcagcagctggattgactgcggcaatgaaaaacgcagaatgagcccggtgaggatggcggtcaaaatggtgccaaaaccgatcggcccacccatgccccatgccgcaaacaaaatggttaattccatgccgttccgcacccattgcacactccagccggttttttctgtaatcagcatcatcagtgaatcacgcggccccgcgccaaggcctgctgatacataaacaccgacgccgtaaccgatcagcaccacgccgagagagaagacgatgatcgagcctgtgtaggtcgagggggcaggcagaatgaaattgaaaaaatctataaatacaccaatgagcaccatattcaggagagccccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcaggcgccctgtttcagcgtgttggcaaacccttgcattcgttgtcaggcctgtgcttcggtgctcacgaatttaacattcgctgtgctccaatgctcgcccttcctagacttcaaaggttttcaatcacgctgaaaatcacaaaatcctaaaacgaaaatcgttttaggattttgtcaataatctggaacagggcgctggcgccctgtttttcttattacagcgggttcaaaatccggtttaagaaccgctgtgtccgttcttcttttggtgcggagaaaatttgctccggcggtccttgctccacgataacgccgccgtcgatgaagatgacttcatccgcaacctcctgcgcgaacttgatttcgtgggtcacgacgaccatggtccagccttcattggccaagtccttgataaccttcagcacctctccgacaagctcgggatcaagcgctgaggtcggttcgtcaaacagcatgagctcaggctgaatcgccagtgcgcgggcgatgccgacgcgctgctgctgtccgccggaaagctggaatggatataaatccattttgtccttcaatccgactttatctagaagctgaattgcttcttttctgacttcctctttgttccgtttttgcacctgaacagggccctccatcacgttttcgagggctgtgcggtgcgggaacaggtgatacgcttgaaacaccattccggattttcggcgaagctttaggatatccgcctgtttcacctttttggagaaatcgatggagaaatcatcaaatgcaagctctccgcgattcgggatctccagagcgttcaggcagcggagcagcgtcgttttccctgaacctgaaggcccaagtatggcgatgacttttcctttttcaatcttcatatctatcttttttaaaatttcattttcaccgaatgatttgtttaatcctttaacggtaagcatactcggaacctccttatttggccacatagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgcccggatgatttcagatgcataggcgccgacgtttaatgaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttagaaagagtcccgtcctctttcatttcttttaatgctttgttgacttgatcaacaacctcgccgcttcctttacggaacgtgaaatatgttgactgaggatcacctgtttcaaacgcgattttcacgtttttattgccagatgtttttaagtagttcaatacggcaagcttatcgttgtatgtcatatcgacgcggccttgctggatcatttgaagggcctgcgccatgccttcaacgccttctactttcgcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgagaaatcatatttgtcttcacgatctgtttttccgacttggttggcaacaacgtcaaaccgtttggaattcaggccggcaaacatgctgtcccactgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccatctttggcattatcttttgactgattgtcatttcctgctccgcaagctgcaagagctgcaatacttacgaccatgaataaagccaataatgcttttttcatcttattccccacttttctggttgattttattgaaataaaaaaatagcttacaaatctaaaggataacttttttttagtatgagtcaagtaattggttttcataaggcaaaatcttttaaaataaatccaaaaattgctgtgccggtttaggcaaataactgtccgttctccacatgacagccggtgtcataatgaaaggattattttcgatatggacggtgtgaacgtgatttctcatatgaacgggaatcattgtgacaggcaaaatagacgcgccgaatccggatgacacgaggctgagcaaagttgcagagtcgtggcattcacaaacaatgcgcggctccaggttcaaacgatgaaattcattcatgacctgattatagacgccttttccgttgacaggccgcagcaggatcagcggaaatgaaggaatgtcctccatcttaatggtgtctccgcacggatatccggcttcatctgaaagcacgagcacacatggaatgtcatcaagctgcttgaattgtactgtgtcacttttgatcagtgttgtcgtgaccgccgcatcgatttgccggctttccagcagttccaacagtgtcgcgggctcattttcccaaatattaaaggtgagatgggggtatctctctttgatctgtgttactttttcaagcatcagagccgcgcaataaattgttgatcccacggcaagtgtgccggctacttcctccttcagctcctgtacctcaatgactgcatcttcaaacctatgcagaatctcttttgctctttttagaaaaacagctccttcatatgtaagagtcatttgttttttcttgttccggtcgaacagaacaacaccaagctcgtcctccagctgtttgagctgcctgcttaaaggaggctgcgccatgtgaagctttttggctgcggacgtgattttctgttcttgggcaatggtaatgaagtatcgaagctggcgaatatccaaaagaaagcgcctccttatcataccttttaggtattaaatatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctgcagtggctgaaggccgccggagtggaaacccatctcgttgtgtctccttgggcaaacgtcacgatcaaacatgaaacaggctataccttacaagaagtagaacaactggccacatacacttactcacataaggatcaggcggcagccatttcaagcgggtcgtttgataccgatggaatgattgttgcgccgtgcagcatgaaatctctcgcaagcattcgcaccggaatggcggataatctgctgacacgtgcggcggatgtcatgctcaaggagagaaaaaaactcgtcctcttaacgagagagacgcctttgaaccaaatacatctcgaaaatatgctagcgcttacgaaaatgggcaccatcattcttcctccgatgccggcattttataatcagccgagcagcttagaggaaatggttgaccatattgtattcagaacgttggaccaattcggcattcggcttcctgaagcgaaacgctggaatgggattgaaaaacaaaaaggaggagcttgatcatggcttatcaagatttcagagaatttctcgctgcccttgaaaaagaaggacagctgcttacagtgaatgaagaggtaaagccggaaccggatttaggggccgccgcacgggcagccagcaatcttggcgataaaagtcccgcgctcttatttaacaacatttacggctatcataacgcgcgaattgcgatgaatgtcatcggctcttggccaaaccatgccatgatgctgggcatgccgaaagacacaccggtaaaagaacagttttttgaattcgcaaagcgttatgaccaatttccgatgccggtcaaacgtgaggaaacagcgccatttcatgaaaatgaaatcacagaagatatcaatttgttcgatatactgcctcttttcagaataaaccaaggagacggaggctactatctagacaaagcgtgtgttatttcccgtgatcttgaggaccctgacaacttcggcaaacaaaatgtcggcatttacagaatgcaagtcaaaggaaaagaccgccttggcattcagcctgtcccgcagcacgatattgcaatccatctgcgccaagctgaagaacgcggcatcaatcttccggtcaccattgcgctcggctgtgagccggtcattacaacggcggcatcgactccgcttctctatgatcaatcagaatacgaaatggcaggcgctattcaaggcgaaccatatcgcatcgtcaaatcaaagctgtctgatcttgatgttccgtggggtgctgaagtggtgcttgaaggtgagattattgccggagagcgcgaatatgaagggccgtttggtgaattcacaggccattattccggcggacgcagcatgccgattatcaaaattaaacgcgtctatcacagaaacaatccgatctttgaacatttatacttaggcatgccttggacagaatgcgattacatgatcggcattaacacatgcgtgccgctttatcagcagttaaaagaagcgtatccgaacgaaattgtggcagtgaacgccatgtacacacacggtttaatcgcgattgtttccacaaaaacccgctatggcggatttgcgaaagcggtcggcatgcgcgcactcacaacgccgcacggactcggctactgcaaaatggtcattgtcgttgatgaggatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattcttgacgccactacaccggttgcgccggaaacaagaggccattattcacagccgcttgattcgccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacaaatcccgaaaaatacaatccagcgtttaaaattgatccaaaggaaacagaaacagcaattgaagttccggcggtgccggaacgaaaggcttgatccgcttgaactgtatgtcagaccgtctctttgagctgcttgacgggagctgcctgaatgagaagcagcatgaggccttcgttctgcaaacagtatcagaggatggctggccgcattccgctatgatcagtgcaggtgaaatcatcgcgctgagccgaactgatatccgaatcgctctgtggaaaaacacaatgacttcggccaacatccttcgcacaggaaaagcacagttcacggcgtggtggaagggagcggcctattatgtaaagcttgaatgcgcgcctttaccgcctttgaaagatgccgaatatgaaagagaccgtttttcctgccgcatcgtttcagtgaaagaggacgttgcgaaatacgctgatttgacttctggtgtccgtatacagcttcacagccctgaagaggtgctgagcagatggaaaaagaccctggaagatttaaaacggtaatatcgatagcctgacgccatgcgtcaggctttttttaaataatgaaaacaaaagggggcgtgagaaatggaacgtgcggggatctgtcactcggacggctttgatttagcttatcgaattgagggcgagggcgcacccatccttgtgatcgggagtgcggtttactatccgcgccttttttcctcagatatcaaacagaaatatcaatgggtctttatcgaccataggggatttgctaagcctaagcgggagcttcgtgcggaggattcgaggcttgatgccgtcttggctgatatcgaaaggatgagaacatttcttcagcttgaggatgttactatcctgggacattccgggcacgcttttatggctttagagtatgccaggacatatcccaaacaagttcggaaggtggcgctcttcaatactgcgcctgataacagtgaagaaagacagcgaaaaagcgaatcatttttcatggaaacagccagccttgagagaaagaaacgatttgaaaaagacatcgcgaatttgccgcaggacatcgacaaagatcctgaaaggcgctttgtgcacatgtgtattcgcgctgaagcgaaaagcttttatcaagagcggccgcatgctgctgccttatgggacggtgtattcacgaatatgccgatcatggatgaattatggggcaatacatttgcccagattgatcttattcagcggttagctgatgttcgtatgccggtgtatatcggattagggagatatgattatttggttgcgcccgttgcgctatgggatgcagttgacggtttatattcccatgtggataaggttatttttgaaaggagcggccatcagccgatgctggaagaaccggaagcctttgatcaaagcttcagcaaatggctggatcaataaaaaaacagcccgcagatcaaaatccgcgggctgtttctgattataagacccctttcatcgcacgtttgataaccggcgagagcagcaggagaatgccgccaagaacgatagaaatcaaaccgatggtgccgaagtacattgtttcaggaattttatcaaacaatccggctacttgggcattgatcgcttgggctgctgcgttcgtcagaaaccacatactcattgtctgtgcagagaaggcagctggggccagtttcgttgtcacggataaaccgactggagacaggcacagctctccaagcacgacaagcaggaagctgagaacgagccaaagcgggcttacgagtgcttcttttccttgcatagcagggaataccataatgataaatgataatccggccaaaataattccgattgagaatttaactggtgtagacggctggcgtttgccaagcttcatccagagccatgcgaatattggcgcaaaaatgacgacaaacaatggatttaatgattggaaccaagatgactgaagttcgaatccgcccaatgaaagttttatgcgttcatcagcgtataccgcaagaatggtcgctccctgttcctgaatggcccagaacatgacagcaccgataaacaaaggaacgtaagcggcaagacgggatttttctgttttgtccgcttttttgcttgtaaacatgatgatgaaataaatgacaggaatcaaaataccgagaatacttacaaggtcgataaaacgattgatcgtcagcacgcctgtttgtacagagatcatcactgcgatcgccacaatgataacaccgattccggtgccaatcgcagattttttagacagcggattcggcacattggaacctgcaagcccgaggtttttctttcttgtcaaagcaaatacgataagtccgagaagcattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaataataagtgccatgctgatatagaatgcgatcgcgctgcccggataggcgagtgcaatgtggccgaacataatgaatatgccgccgtaaaacacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgctcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccataatggaaaaattataaatacctaaaaatagtgattttctcctaatttttatactctttatcgtgagattttcttacataactattcctttaataaaattttagagaaatgtacaagcagatcgggcctttgtgagtaacatgatagtaatcatagagaaggaggctcgcaaatggctgaattcatattaaatgcagcggatttcggtgttcctggagatggtaaaacggattcgacagaacggattaatcagtgcctcagtacagctgtttcgaaaggctatcatactgtctggtttccaaagggaacatatttaatagacgcaacgcttggcggagatcttaatcagaggtttcgaaacgcggggatcattgttcccggcaaccttgagattatgatggaccccgaatgtatcatgaaagtgataccgaatagttcgtggggttattccgcattttatgtaggcaagcaagagaatataaccatttccggaggacaaattatcggcgaacgggatgagcatacgtatgtctcggcggggataaggtcaacccatgaatggggctttggcatatgtattgaaggatgctcgaatgttctcattgatgatgtgaaaatttccgattttaccggcgatgggatcatagtcagcccaaggggattaaagaccaatcaagattatcgaacgtcagagcaaattatcatccgccgctgtgaggttcggcggtcgaggagaaataacatttccattaccggatgtgacatggtcacggtggaggagtgcttgattgaagatgccggaacggggaatggaacagccccgaaattcggaattgacattgaaggatatggcgaaggtgacgttgattatgaggaaccgattaatgtatcaattcgcaataaccactttgttggaaacgtttcaagttctgtgaccaattttaacgggtatggcattttaatagaaggaaatcactctgacaatacaatcagctacggatatgggacgcaaacagtgatcaagggaaatatactgaggcgccctgaagacgcggcggctgcgccaagagtcgggataaccggactcggtgtatcacaaggaaaagagaccagtgatgcagtgatcgctggcaacctcattaccggattttcaactggaattgatgtcaggggaaagagcgttcttgtgacgaacaacaaaatcagcaactttgaaaacacagggatattggtttatcagtcttccgacgtaaaggtagacggaaaccaaattcaaaacggactgtctgaaacaaggcgcagcatcggtcttcgcgcagtgctgtcagatgacatcgcttttctgaataactgtctcattcaagtcgttgacggtgtgaacgtttccggcggaaatatgatcattaaagataatctcctgagaaaattcagccggggcatttggattgctcaagggaacgcggtgattgaagggaatatactgaatcctgacgcgtttgaagcagtgccggaatcatattctgtttccgtcacaaacaatgccggcgccatcatcaaaaacaatacatttaaagagttcaaaaattaccccatttattgctccacaagtgcgaaaacctcaattatcggcaaccacttagagagatctccgcttttggtcaccatctatatcagcgccggtgtgcatgagatttttgataataccatttcagtcaacagaacagccgggaatccgattgtgatttatatcaatggctctgcaggctctatcgtctcaggaaacaccatcaataacctctccgcggtcactgcgacagctattcaaacaaccacatcaaccaattccaaaatcatcggcaaccgcatttttaaagggaccatcaacaaacatagcagtgatacaatagacggcaatatgattgtctgaaaaaagcgccccctctaggggttcttttttttcgatttatagatcatgtagatttctctaacaagtactaacacaaaaaataaaagcacgacccattccgcaaatgttgtcatcttaaagctggacatattgttataaacggcttttgttaaactgaacccttgaagcatgtccatcaacacagaaatagctaataaacaaattaatatgactccggtcacgcccaatatcttcatgcttcatcatcctccgcttttagtgtctatcgttggcggagaagttataccgcatctaaccctaatgcataatctcaattttaaaaggaagaatatgagaaaacgacaagggaaggtatttgtgtatgcctttattttctaagcgaaagaacaataccggttcaaaagacaagcagaatactgacgaaaggaaccaggaacagcagcaagaaaaagaaaggccggttctcatttctccaagtttggcaaagaatatagcggaaacgaaaaaggaagtcggaagcagctctgacgtcatcattcgcgagattaaaatcggggagcaggatcatgtccacctagctgttatctatattgctgggctggtcgataataacacgatccatgagtcgttaattgacccattggtacaggatgagtctatccagaatactcatgcgatccagcaaattcttgaaaaaacgctcccgctgggcggggtgaaagcggaaaagagctgggacaagcttttttccgagttaatgctcggcaatgcgctcatttttgctgatggccatgatgaagctttgatttgcagcactcaagggggagagcagcgctccatccaagagccgagcacccaggcgtcattccgcggtccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaggaagtgaagctgcgcctggaaaaaatagatattgacagtattttggaatctggatatattgagcagctgattgaagatgaaacctttacgacgtttccgactatgtatcatacagaacgccctgatgtagtagcgggtaatctgttagaaggaagattcgcgattattgtggacggaacaccgtttgtgcttattgccccggccttatttgtccagttttttcagtctgttgaggattattattcgcgttttgacattgcgacaagtataagaattcttcgtgttttagtctttttcatttcgcttgtggctccggctgtatacgtggcagccacgacgtttcatcaagaaatgataccgactgagctgttagtggtcattgcggcccagcgggaaagtgtcccgtttccggctgttgtggaggcgctgacgatggaggttgcttttgagattctgagggaagcgggattcaggctgccccgggttgttggctcggcagtgtcaatcgtaggcgcgctcgtaatcggccaggctgccgtacaggctggtatcgtctctccggcaatggtgattatcgtggcactcaccgcgattgcgagcttcgcaaccccggcgtttgcaatggcgatttcagcccggcttattcggtttatttttcttattgcctcagctgttatgggtttttacgggctgattttagggatcattatgatgtttgtccacttatgcagtcttcgttcatacggcgttccatatatgtcgccgcttgcacccttttcttcacaaggcgtaaaggacacgcttttccgggttccgtggtgggccgatgaaaaaaggccggaatcggtcagcaaggaagataaggtgcggcaggggcaagatcaacgcccagagccggccgcttcacgaggaatggtgaacaaagatttggaagaaggggataagaatggtacgtaaatgtctattagtcgttctcatgcttttgagcgccattgtgctgcccggctgctgggataagagggagctgacggatcttgcgattatctcggcgattggcatcgatcggacaaacgacagcaactacgtgctgcatcttcaaattatcaatccagggaatgttgccggcggccttcagggaggaggtgatggagacaggccgcctgtatctgtctattcgattgaaggtaacaatttaacggaagcactcagaaaagcctccataaaggtatcacggcggctttattttgcccataccaacctagtcgtaatcagcgaaaagctggcgaaagaggaagggctggattttgtattagacaatcttgaccgggacacggaattcaggacaacggcgaccttcgtcgttgcccataaaacaaaagcagaaaatatcgtgaaaatcctgacgcctattgataaaattccgtcaaacaaagtcaataaaaccctcgatttcacggaggcgcaatacggtcgggtggtcaaaaccaatattcaggacgttttgaaaacacttgccagcgacacaagggcaccgattattccgggttatttgatgattggcgatgataaaaaaggagtcagcatggaaaacacgcaggcaactgacccgaaagccattcttcaggcagacggcttggcggtttttgataaggctgggtatttaaagtattggattgaagatgatgaaagcgtgggggcagtctggcttatgaataaggtccagcatacgtttattaatgctgattggggcaagacgaaagatgcggtcagcttgcaggttacccatcaagatacaaagctggtacctgatatgcggaacggacgtccgcacatccatgtgaaagtgacggttgaaggaattatagatgctgtcaaataccctttccaattgtctaatccgaaggtgctggccgctattgaaaaatcgctcaacaaagagcttgaaaaggaaatcagccatactgtgaaaatgatcaagaagaataagatagattttgtcggttttggtgacacgatatatagaaagtatccggagcagtgggagaaaatgaagaacacatgggacaaagaatatttgcccgaactgcccatcgatgtgaaggccgagacgtatatcagaaggacgggattgcggaacaatccgatcaaacaccagtttaaagatgattaggtctgaagaaaggagaagtgacagatggaaaaagccagaataagcataaggcagctgtttgtcatgattatcatttttgagctgggcagctccttattgattacacccggatcaatggcgggcagggatgcttggatcgcagttctgttggggtgtgcggccggtttgtttcttttctatttgtatcaaggaatttatcaatgttaccccaattcttctccgaaagaatatatggatgatatgctgggaaccaagctgagctggctgttttcatttctctatattttgtactttgcctatattgccgcaagggtcctgcgtgactttggagaaatgctgctgacatttgcttatcatgatacacctatcattattgtaaatggtttattagtgatagttagcatatacgctgtaagaaaaggaatcgaagtgctcgcccgcgcggctgagctacttttcggagccatgtatttactgggcgcgatcggcctcgtgctgattgttgtctcaggttctatagacccgaataacttaaaaccggttttggcagacggcatttctcctgtcctttactcagttttcactcagaccatgtacgttccgtttggcgaagtcgttttatttgtgatgattttccctaacctgaatgacagaaaagatgtgaaaaaaatggggatgattgccatagctattagcggattggttgtggcgctcaccgtggcgattaatatcagcgtgcttgatgttgatcttacactcagatcccagttcccgcttttaagtacgattcagacaatcaaggtcgaagaatttttagaccggctcgatgtcttttttatgctggcgctgatcatcggcggcttctttaaggttagcctctacttatatgccactgtggttgggacatctacgctctttaaggaaaagaacccctctcaattggcttatccgatgggattgggcatcttaatcctttctataacgatcgcgactaacttttcagagcacttgaacgaaggcttgaacgtggtgccgctgtatattcatttgccttttcaattattgtttccgctctttctgtttattgtggctgtttggaaaaagaaacgaagagagaagtcaaaaggggcggaagcaaaaaaatgataaaaagagcggggggatgcagccgccgctctttttatgttcacttctatataaaagggggatatagggtgcgcccctgtctgcactggcagaggcgcgttttgttatacgactgcgatgttttccttcacagtaaagcttcctcttgaaagtctgatattgatgtctgacacttttgcaatttgttcatcgtgcgtcaccatgatgacacatttattttccttgtgtgccagatcttgaaagagccgtacgatctcttttgatgtgtcctcatcaaggtttccggtcggttcatcggctacgataagattcgtgtcacagcagaaagcccttgtaattgatacccgctgctgctgtccgccgctcagtgtgagcactttttgccgggcttgtttttcgttgatgccaaccttctgcagcatgtcaagcgcatatgattctttgtttttttctttagaacctgtgatttccatagcggttgtgacgttctgcaaagccgtcatatacgggagcaggttgtacgcctgaaagacgattgatacatattgatttctgaaattggttaagccgattttagaaaccgcttttccgtcgtaaaggatgtttccttcttttggtgcgtcaagtccgcctgccagagacaggaaagtggttttccccgtccctgatgttccgacgattgtgtagaattttcctttttgaaagctgatgttaatatcctgaaacaatggctggcttttgtctttataccagtagccgacttgttgaaattgtaataagctcataggttccgcctctttctattcctgttttgtcaatatcgttttcggatgaagccgcagtactgaaattgacggcagcaatgttgcaatgattgcgattaggatgccgatcccgccaagaataagcatgtcgttcatagaaaccgcgacgttcagtgaatcgataacgtccacgtttgatgaactgtggccgaacattccgccgcccatgccgccaccgccgccgggcatttgtccgcttgcggtttgcgttgaatctgttgatgaactgatctgctgggataaaagctgatttccaagctgattcgcgacgagatttcccgtcacagatgcaaggccgatagcgataacggccacaatcagaatctcagtcaagaactgtccaatcaatttccatcgtttttcaccgatggccattaacacgcccatttcgtatttgcgctccctgattgacatcatgacaatcaggccaaggatgacggcgcctgctactgatacaagatacacgacgtttttagagaaagaagccacattttcaatcgggccgaccatttgctggtaaagctgatcgtttgtattcagtgtgtacgtatcgaagtcaattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataaggatttaagaaagagaaattttgggcttggtcatcacctgaagatgttgttttataaataccgacgatcttcagctttactgtcgtatcttcatctgttgctgattcaattgtgatcgaatcgccaacgctcaaatcattttcttccgctaatgtttcgttgatcactgttacttttttgccgacatctgattttgtaatcgcgcgtccgtctgtgatttttgaatccccgtcagagaagtcatcaactaatgctgtgctgatgacaccttcaatcgaaagatcggcttgcaccatttgcggtccgccttgtccgccgccttggctgtttttagcggttgagcttgaactgctggagctggaatcacttgaactagagctttcaatcgcatcaaagtttcctgcgttggctgaagctgatgtggtgtaattgtagctcttcacatgatcaagcgctgcaagcttattcgcatcagacactttgatcggtgttgattcgaagctgcgtttttcaccgctgtcctgctgcttttccatttgcttttggcggtcaacctgaagtgtcacgcttccgccgagttcctgtctggccagttcgcttgacttttgtgctgccgactggatggtgaggcctgatagaacaaagacacatatgactgtaaacacaaataattgcaataacgtttttccctttttagccttcatattccaaaaggcccgtttgataaagttcatttatgttcctccgcattggtatttttattgataagaccgcctttggggcgcgtccccttgctgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaaccggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcatcggctttgagatgggggcggacgattatgtcacaaagccgttcagcccgctgacattggttgcccgcatcaaagccgtcatcagaagatacaaggcgacaggcaaagcggttattgatgaagatatgattgaaacggaatgctttaccattaataagaagacgagagaagtattattaaacggagagcctgtagaaaatctcacgccgaaggaattcgatctgctttattaccttgtccaaaatccgcggcaggtgttctccagagaacagctgcttgagcaggtatggggctatcaattttatggagatgagcgaacggttgacgttcatatcaaacggctgcggaaaaagcttgccagcgaggacaagcctttcctgtatactgtgtggggagtagggtataaatttgatgaagattaaatatttatatcagctgctgctaagccatatcagcattttgattttagcgtttgtcattatcatttctctgttttcccactttgtgaaggaatttgcctatcagaacaaagtagaggaattgacgtcatatgcggtgcagattgcaaatgaattccaagccggccaggtggacatgcgcaggctctatccttatcaggacatgttaagcacaagaaagacgcagtttatcatctttaatgaagagcagcagccctattttcttcctgaaggctttcatcacccaccaagggaacagctgaagaaatcagaatggaataagcttaaaaaagggcagactgtcatgatcagggcagatggccgttttgatgatgaagtgtcacttgtggcgcagcctatatttgttcagaacgaatttaaaggcgccgttctgctgatttctccgatcagcggcgttgaacagatggtcaatcaggtcaacctctatatgttttacgctgtgatcagcacgcttgtgattacgattctcgtgagttggcttctgtccaaattccatgtcaagcggattcaaaagctgagagaagcgacagataaagtggcttccggcgattatgacatccatttggaaaacagctacggggacgaaatcggcgttctggcctctgactttaatatcatggcgaaaaaactaaagcagtcaagggatgaaatcgagcgccttgagaagcggagaaggcagtttatcgctgacgtgtcacatgaattaaaaacaccgctgacgacgatcaacggtttggttgaagggttgaacagccatacgattcctgaggataaaaaggataaatgcttctcgctgatcagtgaggaaacgaagcgcatgctgcggctcgtaaaagaaaatctggattatgaaaaaatcagatcccagcaaattaccttgaacaagctagacgttcctctgatcgaggtgtttgaaatcgtgaaagagcacttgcagcagcaggcggaagaaaaacaaaacaagctgatgatccaagtagaggatcacgtcatcgtacatgccgattatgaccggttcattcaaattctcgtcaacattacgaaaaacagcatccaatttacgcaaaacggtgacatttggctgcgcggaatggaaggttataaagagacgattattgaaattgaagacacgggtatcggcattccaaaagaggatattgagcatatttgggagcgattctataaagcagatatttcaagaacgaacacagcatacggtgaatacggactcggtctctcgatcgtcaggcagctcgttgaaatgcaccagggcacagtagaaatcaagagtgaagaagggaaaggcacaaagttcatcatccgccttcctttaacggcaaaacagcaatagcatacagggcggcggcatcatctgatgcatccgccttttttgcacaccgcttcggtttattgcgtgctcccgaaaacaaagattgcgtgtttttcgggttgggacggtctataaacatgataaaatatgacataaacagtttttgatgggagagggtgaaggaatgaagagcggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaaccaggcagatctcaaagggctgctcgactattacgtgaatttttttcgcgggatgtatgaatttgataagcgggaatttatttctgccattacatactataaacaggcggagaaaaagctctcctttgtcgcagaccatattgaacgggctgaattttattttaaaatcgcggaagcttattattatatgaagcaaacgtatttttcattgattaatataaaaaacgcctatgaaatttacgtggagcaggaaacctataatgtgagaatcattcaatgccatttcgtcttcggggtcaacctgatggatgaaagaaatttcgaacaagccgcacgccatttcaaattggcgctcaatatggcccaagcggaacaaaaagcccagctggtcggaagagcatactacaatctcggattatgctattacaatcaagaccttctagaccctgccattgattactttgaaaaagcggtctccacgtttgaaagcagcaggatcgtcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttgcaatccctatatcaggatcagcccaatgaagaaggaatcgaacgatgtttccagtacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcattagcgagaaggggtttttcttttcaaaaaaacaccgcaggacatagtcttgcggtgccgccttcatggagattacgtttatttagtagcctcctacaaatgcagttcccacaatgatcaagaggataaataacacaacaatcaaagcgaaagaagttccgtaacctgacattttgtgcacctccttgcgagattgcttcagcatatactgcaaaactgtggcggacagggttccgcagagacggtcagcagcttagtagccgccaacaaacgcagtccctacgataattaaaagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaagaattcggctatatgaaggtgatataaaaaatagcgggcgctgccgcccgctatttatgtacgattaagagatcagcacgcccgcgaaaaattcccggtataacgcttggacggcttttctttcttcggcttcttttacgccaaacatcatgctcacttcagaagatccctgattgatcatttcgatattcacctgtgcctctgataatgctttggcggctcttgctgttgtaccgacattgtggcgcatcgcttcccctacaaccataatcagggcgagatgatgctcgacgatgacttcatcggcatgcaaatcctcttcgatccgtttgatgacgctgcgttcagtggcggcatccatttgcccctgccgtaaaatgatcgtcatgtcatcgattcccgatggaacatgctcatacgtcaaaccatgctcctccagaatttgaagggctctgcggccaaaaccgatttctctgttcatgagatacttgctgatataaatgctgcaaaaaccggtgtcgctggcaatgccgacgacaggcccgtttgtgtgatcccgcttgctgacgacgcgggtgccttcggctgaggggttgttcgtatttttgatctgaacaggaatccccgctctgaatgccggaatgagcgcttcatcatgaaacactgaaaaacccgcgtaggacagctcccgcatctctctatatgtcagctcgctgatttcctttggattctcaacgaaggacggattgacagaatacacagcgtctacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccagcatccttcgggtttacatattccgctttgacgcctttataacggaagtaagcggcgatcagcttggcattgttatcctctccgctggccttgactgcgtcaaggtattgctcgggattgcttttatctccttctaaaagcgtaaacagatcatttctgattttttcgataatgctttgccccagctgaagctcattggcgatgagagcgtaccgttccacaactgcttccgccagttcaggtgcgctgcctgttgccaaatattgttctgcacatgcgattaagagatcagtcactttcgtatcctcggcatagcgttttcccggagctgaaacgactacagctttccgtgccggatctgaggtaacgatgtgaaacaccttgtcaagctgggcgcctgaagcaagtgagctgcctccgaatttaacgaccttcatgtttacatctcctaatgtttaaaattttcacacaaatttagtatttattatctctctttcagtactgtaaatcaagggggaatttctatccggggagaacatttgtattttccacgaggaataatgttaggtttgctgaccgtatacctgcgttataaagataaatatggtaaacagcctaacgttttgggatggaaaatggttagaatgattagtaaaatggattaatgactaggttaatatttttaaagaatattgactaaccctagaaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcatcgcgggattaagcatgagcatctgcggtttgattatgcagcagatcagcagaaataaattcgtgtcaccgacgacggcgggcacgatggattgggctcggctcggcattttaatttccttgctgctgtttacatcggccagtcctttaatcaaaatgctggtcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctgaagtacaaacgggttgtgaacatcgggctcattatcgtgtccctgatcacgtcccttgtcattttgactgtcggtatgctgccgtttctcggtttaatcatcccgaatattgtatcgatttacagaggagacaatctgaagagcagcctgccgcatactgcgctgttgggagcggtgtttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttggtttagccattgtatgtattggcttgtttttgttttatgacttaggcaattgggattacaccctgccgagacgaatcaaaaaagtcgctgccattgtgctgactgggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcttttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaacttttcgatgtgctgtcgctcggacgcgagcacgccgtgaatttgggtattgactacgacaaagtggtgaagcagatgctgatcgtggttgcgattttggtttctgtttcaacagcgctagtcgggccgattatgtttttaggccttctggtcgtcaacctggcgagagaattcctgaaaacatataagcattcatacttaatcgcaggctccgttttcatcagcatcattgcgctggtcggagggcagtttgtggttgagaaagtgtttaccttctcaacgacgctgagcgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacatagacggacaagagattggagcatgtgacagcaaagagcttgccaagaaaatgagcattttgaagcaggcgaaccaaatcaatatcaggctcacgatcaaagacctcgtcagttttggcaggtttccgtactcacagggccggctgacagaggaagactgggttcatatcaaccaggcgcttagctatatgaagctggaagacattcaagacaaatacttggatcagctgagcggcggacagtgccaaagggcatttatcgccatggtgattgcccaggacaccgattatatctttctggatgagccgttaaacaacctggatatgaaacattcagttgaaattatgaaactgctgaaacgtctggtggatgagctgggaaaaacgatcgtgatcgtcattcacgatatcaattttgcttcagtctattctgactatatcgtcgctttgaaaaacggccgaatcgttaaagaaggaccgcctgaagaaatgatagaaacatcagtgcttgaggaaatctacgatatgaccatcccgattcagacgattgataatcaaagaataggtgtttatttttcttaatatatagaagaggtgaggagcatgaaaaagttcgcgttactattcatcgctttggtcactgccgttgtcatttctgcatgcggaaaccaaagcacaagcagcaaaggttctgatacaaagaaagaacaaatcacagtgaaacaccagctcgacaaaaacggcacaaaagtaccgaagaaccctaaaaaagttgtcgtatttgactttggaagcttagatacattagataaactaggacttgatgatatagtagcgggcctgccgaaacaagtccttcctaaatatctgtccaaattcaaggatgacaaatacgctgatgtcggcagcttaaaagagccagacttcgagaaagtggcagatttagaccctgacttgatcattatctcaggaagacaatctgagtcttacaaagaattctctgaaattgcgccgacaatttaccttggcgtagacacagcgaagtatatggaatcatttaagtctgacgcagaaacaatcggtaagatcttcgataaagaagatgaagtgaaggatgaactcgcaaaaatcgatcattcaatcgcagatgtaaagaaaacggctgaaaagcttaacaaaaacggtctcgtcatcatggcgaacgacgggaagatcagcgcattcggtcctaaatcaagatacggcctgatccatgacgtgttcggcgtgacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaaaaatgtaaacgcagtgaaaaatggtcatgtcatctaccttgattctgctacttggtatttatcaggaggcggacttgagtctatggcgcaaatgattaaagaagtgaaagacggtttagaaaagtaaaaccaaaaagagcctccgctaaatagcggggctctttttttgttaatcagcgtgccggctgctgttcggcagggcgctgaggtttctttaatgtgaatgagagaaggaagccgacaagtgcaatgacggcagccactataaaagcggcgttcatgccgtgcagggcggcgtgcttcacatttgtcgtgcctgcatgtgccgcctggttgctcatcacggaaaccaatagtgcggttccgatcgagccgccgacttggcgaatcgtgttgttcatcgcagttccgtgcggaatcaagtggcgcggcagcgcattgattccggctgttgtcaccggcatcatgatcatggcggtgcctaagagacgaacggtgtataaaacgacaatccaagcgagtgacgtatggtcagtcagctgcataaacggcagagatgtcaggaagatgatgcagaaaccggcaatcgccagccctcttccgccgacacggtcaaaaattctgccgataatcggcgacataaagcccatcacaacggctcccggaaggagcataagccctgtatcaaaagctgtgacgtctctgacattttgtgtataaagcggcaggatggtttccgtaccgatcaataatgcaaagacgagggttcccagcagtgttgttaaactgaaaatgccaaacgtgaagacgcggaattccagcatcggtttttcaagcttcatttgtcttgtgataaacaagagcagcgcgatgacacccaccagcagtgaaatcaagacggttgaactggaccagccgtaagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgtttttcaatcggaaagattgtcaggaatacagtctgcatgagcggcatcataatgccggctccggccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttggttaacataaatgatgttgtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttgtgttcaatacatatcccttcttttctctaagtaattaacagtgtttttaacatggaaacgggctgtgttaaaacaccggtttgttccagatagccaatcagtgatttgagtaaaaaagcgcggggttcttccttcttcgcttcttcctccagcatagcggctgcggatgtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtgaagctcaagcggtttttcctcgattttgatcagcattaaaaactcacgcatcataccatgaagaatgatgaccaaatcccacacaaatgggagaatggtttctccatacgcctggatcagcgaatcgcggtgccagcagataatcgtcgatctggtctgatggatatgctgtttgacccggtcattatgcagcttggggtttccgtaggtcagcatattgaaaaactgctgattccgcctgaagccctccagttccattttgaccttttgcgtcaaacgctcctccggtgtaagtgcggtattttcctgaagtcttgaggccgcggccaccatttgcttctggttaaatgacagcagctccaaaagcagatcttctttagattgaaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaacaatgaaaaaattttaccagataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccagtttcttgtttcttttccgtttgtccgtttattcatgtattcagacatctgttcgtcgtatgcctgaatgtgagacgtcagctcatcctgattcaaataagtttcctgatgattgacagcttcctgcggtaagcgcggttttttcgctgaacggtcggcaggatgcccaatgacaaggccggataaagggaacacgtatttcggaagctcaagcagttcgatcagctcttgagggttcccgcgaactgcaccgatcggaactgtgccaagtccgagtgactcagccgctgctgttgctgtgccgagggcaataccagcgtctactgcgccgacaagaacagattccaatccatttgtgatttccattttgaaatcatgcagatcttcaagcgcaattttggcccggttgaaatctgcgcagaacagcaggaaaacaggagcttgatcgatccatggctggccgcctgccagctcggagattttctttttgcgctctttatcctggactgtgatcacagtcacttgctgtccgttgatagaagaaggggctgattgcaccgcttcaatgatttggtccaattgctcctgagctacaggctcatctgtgtagctgcgaatcgagcggtggtctgttaaagatttaatcacttcattcatatgagacacccttcctttactcgctaagctctgtgcggacaacatcaagaggggcgctcagcagttcttttccttttgcgacaaacccttggaaatgcgcagtttcgttatggaatttcattgccgcttcatctttccatttttcaagcatgacaaatgtattttcttcgcctactttttcgaataggtcgtattgcgcgttgccttcctcagctcttgaatgctgaacaagtgattgagcctcgctcaaaaattcctcgcgtttttctggttttactttgatgtaagcttgtaatacgatcatttaaatctcctccgttgttatgcgaatttattgttcgaatttcatcgaactaaatgtaacatgtattctaaatgaggtaaaggaaaaacccttatatagtaaaattgtcattctaattgttgtgtgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttgtcgcatcattttaaagttttgagagaatcgggcatcgctcaagttcggatagaaggaaagcgccggtattattcgcttcgcgctgaagaccttgaaaaggcatttccgggcctgcttgaagccgtgctgaatgtagaccaggaccgctggtgaatcaatcccctgtaacggggatttttttatgtccgtaaaccgctttgaaaagccgctgcacacccgcctgaatatcttcttccttcagccgtgcaaagccgataatgagagctggcctgcccgtttgccgcttgttttccttcaagttaaatcggctcattccgaatatttcaagctgcagcccggcagcatgtgacaggatgtcttgttcggtgcgcctggtatcaaattcggtaacaaaatgcagccccgcatttgccccttttacggtaacctctccgctgaactctgcttctaaagcggtgatcaggcgttctctcttttctttataatgctgcttcattttttttatatgcttctgatattcaccagactcaataaattcctgcagggtgagctgtgtaagtgatgagcaagtctgcagatcatagccccgctgtttgtatgtcctcaacagctcaggcggcaacaccatatagctgatccgcaagccggggagaagggactttgaaaaggttcccatatagatgacattttgaaaacggtcgaggctttgcaacgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcctttttcatccagcatgatcgtctttacttgttttccggcattcttcaaaagctgatacatgcgcctgtagccaggctcctccatcgcatacacggcttccttgggtaaaagctcagtcaacagctgcatgagcacctgtgtgcctgcccctatgatcatttgttccggcctgcattttacacccctcgtcagggaaatgagcctggtaatggccgctctcacttcatatatcccttgcggatgtgacatatcgccgagcgtgcggtatgagcgggaggccgctttttgctcgcagcggaaccagcttttgatcggaaaatggtctgtatcggaactcatgtgtgaaaacgatatccaatcgctctggtcgatgtgaatctcttttaggtcatccggcagtgtaaatggagggtgctcctcggcggaaaacatgtctagttcctccacgaagaaaccctttcgttcaatggcgtacaaatacccctcagccagcagctgctgataggctgaattcactgaatttacgctgaccttgagattttcagccagctcccgcttggagggaaccttcgagtgcggcagcagattgcggctgaggatttcttttttcagcttttgataaatttgctgatagatataatcggcttgttctgaacgatcgagtgtaattgtgatatccattttgtagtttctccttctgataccatcaaaaagttataattggtacttttcatcataccaaagagaagtcagaatgataagaaaataccgacagggggatattcacatgagtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggacggccggagatttattgattttgcaggcgccatcggcacgttaaatgtcggacactcgcatccgaaggtggttgaggctgtgaagcggcaggcggaggagctgattcatcctggctttaatgtcatgatgtacccgacttatatcgagttagccgaaaaactgtgtggcattgcaccgggcagccatgagaaaaaagcgatttttcttaactcaggggcagaagcggtcgaaaacgctgtgaaaatcgccagaaagtatacaaagcgccaaggcgttgtctcgtttacacgcgggtttcatggacgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggttattcaagcattcaatgatttctttatcgcttcagtggcgcctgaaacggtggcgtgtgtcgtgatggagccagtgcagggagaaggcgggtttattattccttcgaaacggttcgtacagcacgtcgcttcattctgcaaagaacacggcattgtttttgttgctgatgaaatccaaactggctttgccagaactggcacttatttcgcaattgagcactttgatgtagtgcccgatctgatcacggtttctaaatcgcttgcggcaggcctgccattaagcggcgtgatcgggcgttcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagatagggcgtatgagtggaaaaaagaattcccgttcatcggtgacatccgcagactcggggcgatggccgcaatcgaaatcgtcaaggatccagacacgcgtgagcctgataaagcaaaagcagcagcgatcgcggcctatgcgaatcaaaacggattacttttgctgacagcgggaattaacggtaatatcatccgctttttgacaccgctcgtcatctcagacagccttttaaatgaagggctcagcatcttggaggcgggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagagcgtctcttttgaaaaaatggtatgagctgattgttgaacataaagaagagcttgcagatttaattacaaaggaaaacggaaaaccatacaaggaagcagtcggcgaggtactttacggcgcaggctatatcgaatggttcgcagaggaagcgaagcgtgtgtacggaagaacggtcccggccccgacaacgggtaaacgaattgttgtcacacgccagccggtcggccccgttgctgctatcacgccctggaatttcccgaatgcgatgattacacgcaaagcggcgcctgctcttgccgctggctgtacatttatcatcaagccggcgccggacacaccgctgtctgcttatgaactagcacgcctcgcatatgaagcgggcattccgaaggatgttcttcaggttgtaatcggcgatggagaagaaatcggaaatgtgttcacaagcagtccgaaaatccgcaaaatcacgttcacaggctcaacacctgtagggaaaatccttatgaaaaacagcgcggacaccgtgaagcacgtctcaatggaactcggcggacacgccccgctgatcgtagatgaagatgcagacattgaccttgccgttgaacaggcgatggcgtccaaataccgaaacgccggccaaacctgcgtatgtgccaaccgcctgatcgttcatgaatccatcaaggatgaatttgctgcgaaactgagcgagcaagtgtctaagctgaaagtcggaaatggacttgaggaaggcgttaatgtcggaccgatcatcaataaacgaggcttcgaaaaaatcgtcagccaaatagatgatgcggttgaaaaaggcgcgaaagtgattgctgggggcacatatgaccgaaacgatgacaaagggtgctactttgtgaatccgacagtgctcaccgatgtcgatacgtccatgaatatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagcggttcaagcgccattcggcggaatgaaagaaagcggcattggccgtgaaggcggttcagaaggtatcgagccgtaccttgaaacaaaatatttgtccatcggtttataaaagaatgcacgctcctgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcactcattgtttctatcgttatttacttttttgttcagcccgttctgtcacttcgtatttttattgttggaatcgtatccggcctattttggtcacttggacaggccaaccagctgaaaagcattcaattgatgggcgtgtcgaaaacaatgccgatttccacaggaatgcagctcgtttccacctcgctgttcggtgtgatcgtgttccgcgaatggtcaacaccgattgcgattacgcttggcgttctcgctttgatctttatcattgtaggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggtatggtggtcggggggttagttttaacctatagacacaaaccctttaacaagtatgcgatcagaaatattctcccagggttaatctgggcaggcggaaatatgtttttgtttatttctcagccgcgagtcggcgttgcaacgagcttttccctttcacaaatgggaattgtcatttctacgctcggcggtattttcatcctgcgtgaaaagaaaacgaaacgccagctaatagcaattgcgatcgggattatcctgattattgccgccgccgtattcttaggaatcgccaaaacaaattcataacaaatggaggaggatgtatatgtatccggatttaaaaggaaaagtcgtcgctattacaggagctgcttcagggctcggaaaggcgatggccattcgcttcggcaaggagcaggcaaaagtggttatcaactattatagtaataaacaagatccaaacgaggtaaaagaagaggtcatcaaggcgggcggtgaagctgttgtcgtccaaggagatgtcacgaaagaggaagatgtaaaaaatatcgtgcaaacggcaattaaggagttcggcacactcgatattatgattaataatgccggtcttgaaaatcctgtaccatctcacgaaatgccgctcaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggataaagctgatgacagaaacattagcgttggaatacgcgccgaagggcattcgcgtcaataatattgggccaggtgcgatcaacacgccaatcaatgctgaaaaattcgctgaccctaaacagaaagctgatgtagaaagcatgattccaatgggatatatcggcgaaccggaggagatcgccgcagtagcagcctggcttgcttcgaaggaagccagctacgtcacaggcatcacgttattcgcggacggtggtatgacacaatatccttcattccaggcaggacgcggttaaacaaaaaaagcgacccagacatcacatctggatcgcttttttattacgcacgctttttcttaacaagtgctgctacagataaaataatagcagccgcagacagcacaatcgctgtaatgtctagagctgaagaacctgagttttcggaatcgtcttctgttttcgtggcgccgtgctcatctgtcacttgttttgcagacgtgatgtttgtaatggaatgaggtgtatcggcatcctcgtcacctgtccactcaacaatgctgccgtctttgtaatattggtaagcgtcccaagcggcttcctccgctttgtcagggtttttggcaacaaaggtaaactgctggaactggccttcctgaatgcctccgtcagtcgcttcccacgtcacggacactgatttgtcatcatgtttttgagtggaaaccttccagcccggaattggctcatattgctggaattcaacatccttcggcattttgaggacaaccttcgttgtcggcagatttttctcagaaggaaccttcattgtatacgtttcccaagagcctgcagcagactcagccggttttacagaaacgtgcgcgctggcaggggccgtaaagaataagagggagccgacaatagccggacatagtgtcaatgcgatttttttcaacaacgtaaacactccttaattggtctttgtaaacatgatattgatttcgttaaagtcgccggtcaggccgtggactttgatcttccagtttcctttttcattaatcgacaggttttgatcttggaagacgccttttgttttttcttttaatgtaaaggtgcttttgttttcgctgcctgacaggcctgttttataaacggttaacgtgatttgctggatgtttttcacgggatctccgttatggtcggtgacccgcagctcaaaaacattttttccgggctggtttgggctgatgctgagagaaacgctttgtccgttttcaatcgctttggtttggtagaacggttccggcgccggctcaggcgggcttggcaggcttgtaaacacggccgctgtgatcaatacagcgatgccgattgcccactctgctttcaacgttcggctgattcctgtgcggcgctgctttctggtaagcagaaaatgaatcgcacctaagaccagcatgaaaacaaacagcccgcttttcactaaaagagcttggccgtacgctgtatggaacagtgaatccattgaacgaatgatgaaaaatccattgagcaagcctgaaaacaaaatgacgccgactgcagtgagcgcccatggggagaaccgtctgaccgtctcccacgcgagcgttttgtcaggctgcctccattcttttgagagcagcaaaacgagtgccgctattccgccaacccagatggaagcggaagttaaatgaaggaaatccatcaaaatgccgaccgttttttcttcaacgacagcagcatgcccggtaaacgccttggcgagcaggagaccgaaaaagaaaatgagcggcgctgtccaatagccaaaggatgaaaagcggtttttccgtatcgcagggatgacagacagtgcgagcagcacgaacagcgcagcctgtatgatccaaatggagccgcctgctgtctcaaacagtgtttctctgatgtagcctggctggaatgcgctgccccagccgccgcctgcgttcgcttttgtctgaatcggaagctgaagcaaaagcgccagccccagtgctgcgatcgagccggtcaggatacgtctcgtccgtttgacgagctgttctgatttccctttataccagaaaagatggaagaaaaccgttccgataaacagagataaggctgtatacagaatcgcgcgatctgctgctgttcccggattcagagctgaatcggctgctttttggctgctgaatccgccatccgctttcccgatactgaatggaatgacgccggaaacaggatgtccatccgcggatacggcattccattccgctctgtacacatctttaggcagattcttcttcagcttcactgtcatgatgtgatgattatcttttttgatttcagtcttgtccgtatccacacggtcgccgtttgaattatagactttaatgtaatgaaacccttcttcaaccggttcattaaattcgatttccacctgcgcaggggcgctttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatgtcttccagcgcttggtcgaaagtgcagacggctccgccgaatcctttttgaaatcgttcggcatggtcaagtgtcgcaaacggaatggcctgcggctggcagcagtgcaggtttaattcagcatttacgacgaaataagccgaaccggcactgacggttgtctgtaacagaaaatctctgcaaatcaagtgtgaaacctcttccgttttatccgcgtaacgcaaaaacgcgcaatgtgcgcagcatagctgttcaatgtcttggtttaccgtaatcagctgaaccgaatgagcttgattgacgggcttcaagcaatagctgcacatatgatctgtttgaggtgttcggacggggagcgtgatgccgccggccgttttaatgacctgatttgactgaaccagctgattgacatctctatataccgtcatttccgaaacgccgaaccttgcgctgatgtcagaaattctaagcgagccttcttctttcagccacttcagtatgtgttgctgtctattaatcggaagcattcatacaccctcttcattaagatctatttaagcgtagaggattttagagacggagacaagtaagtggatgataaaaaatgtgaaaatgtgttgaacagcaacaaaacgaaacagaagggactctggtataatagacagatggaatagaaagtgaggaataccctatgaaagaaacaccatgcccgaactgcggcaaacctttgacaggcgatatggtcagatcatcaaatgtgccttgtcaatttcgctgcggccactgccgggaacggctttatgaatataaagtttcagctccgattatgctggtatcattagcggccatcgtgctgcttatttatcttttgatgctcctccgcaatgcggcaggctcagtgctgccagctgtacagcacgtgccgatggctgtatttgcgcttgtgtgcgcgtatcccgtttttattgtgagtgagcggatgattgcaaagtacgtgattcaaaatggcaacatcatttatagaggaaagagaaaaggctcctgaaatcaggagcctttttatttttaaaaaattgtcacagtcatgtgccaaagtcctctttactttcaattgtatagggactgtaagcgttttaacatagagtcaaagggaagcatcattctctgaacatattttttatcttacagcgacaaacaaaacagggagggtttatatatgcagcagcaagaacagcagcaaggcggcatgaaagtgaaagtgcagcgctttgggagttatttgagcggaatgatcatgccgaatatcggcgcgtttatcgcgtggggtatcattaccgcgctgtttattccggcaggatggtttccgaatgaacagctgaacacgctggtcagcccgatgattacgtatttattgccgcttttgatagcgtatacaggcggaaaaatgatctacgaccaccgcggcggagttgtcggagcgacagcggcaattggggtgattgtaggatcggatattccaatgtttttaggcgcaatgattatgggtccgcttggcggatacctcattaaacagactgataaattattcaaggataaagtcaagcaaggctttgaaatgctgatcaacaactttacggcagggattgtcggcgcggctttaacgattctcgcgttttacgccatcggcccggttgtcttgacgctaaataaattgctggcggctggtgtggaagtcattgtacacgctaatttactgccggtagccagtgtttttgtagaaccggcgaaagtgttgttccttaacaacgccataaaccatggaatcttaagcccgatcggaatcgagcaagcatctcaaacaggaaaatcaattctgtttttagtagaagcaaaccctggaccggggctcggcattttgctggcgtacatgttctttggcaaaggatcttcaaaatcaacggctcccggtgcggcgatcatccatttcttcggcgggattcacgagatttacttcccgtacattctgatgaaaccggccctgattctcgcagccattgccggcggagcaagcggacttttaacgtttacgatctttaatgccggacttgtcgcggcagcgtcaccgggaagcattatcgcattgatggcaatgacgccaagaggaggttatttcggcgtattggcgggtgtattggtcgctgcagctgtatcgttcatcgtttcagcagtgatcctgaaatcctcaaaagctagtgaagaagacctggctgccgcaacagaaaaaatgcagtccatgaaggggaagaaaagccaagcagcagctgctttagaggcggaacaagccaaagcagaagaagcgtctgagctgtctcctgaaagcgtgaacaaaattatctttgcgtgtgatgcgggaatgggatcaagtgccatgggggcatccatcttaagaaacaaagtgaaaaaagcagagcttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgacgagctgattgaaaagctgaaaaagtaatcttatagaaagagagtgatactcatgcaagtactcgcaaaggaaaatattaaactcaatcaaacggtatcatcaaaagaagaggccatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactctggaatttcaatcatacagattccagagggcgttgagtacggagaaggcaacacggcaaaagtggtattcggcattgcgggtaaaaacaatgagcatttagacattttgtctaatatcgccattatctgctcagaagaagaaaatattgaacgcctgatctccgctaaaagcgaagaagatttgatcgccattttcaacgaggtgaactgacatgatcgccttacatttcggtgcggggaatattgggagagggtttatcggcgcgctgcttcaccactccggctatgatgtggtgtttgcggatgtaaacgacacgatggtcagcctcctcaacgaaaaaaaagaatacacagtagaactggcagaagagggacgttcatcagaggtcattggcccggtcagcgcgattaacagcggcagtcagcccgaagagctgtaccggctgatgaatgaggcggcgctcatcacaacagctgtcggcccgaacgtgctgaaactgattgctccgtctatcgcagaaggtttaagacggagaaacactgcagacacactgaatatcattgcctgcgaaaatatgattggcggaagcagcttcttaaagaaagagatatacagccatttaacggaagcagagcagaaatccgtcagtgaaacggtaggttttccaaattctgccgttgaccggatcgtcccgattcagcatcatgaagacccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtgacagcgtatgtcggctatcagcgcggactcaagacggtcaaagaagcaatcgatcatccggaaatccgccgtgttgttcattcggcgctgcttgaaactggtgactatctcgtcaaatcgtatggctttaagcaaactgaacacgaacaatatatcaaaaaaatcatcggtcgctttgaaaatcctttcatttcggacgatgtgacccgcgtagcgaggtcacctctcagaaaactgggagaaaatgataggcttgtaggcccggcaaagaaaataaaagaaccgaatgcactggcggaaggaattgccgcagcactgcgcttcgatttcaccggtgaccctgaagcggttgaactgcaagcgctgatcgaagaaaaaggatacagcggcgtacttcaagaggtgtgcggcattcagtcccatgaaccgttgcacgccatcattttaaagaaacttaatcaataaccgatcacccgtgacacaatgtcacgggctttttttactatctcgcaatctagtataatagaaagcgcttacgaaaacagggaaggagaatgacgatgaaacaatttgagattgcggcaataccgggagacggagtaggaaaagaggttgtagcggctgctgagaaagtgcttcatacagcggctgaggtacacggaggtttgtcattctcattcacagcttttccatggagctgtgattattacttggagcacggcaaaatgatgcccgaagatggaatacatacgcttactcaatttgaagcagtttttttgggagctgtcggaaatccgaagctggttcccgatcatatatcgttatgggggctgctgctgaaaatccggagggagcttgagctttccattaatatgagacccgccaaacaaatggcaggcattacgtcgccgcttctgcatccaaatgattttgacttcgtggtgattcgcgagaacagtgaaggtgaatacagtgaagttggcgggcgcattcacagaggcgatgatgaaatcgccatccagaatgccgtgtttacgagaaaagcgacagaacgtgtcatgcgctttgccttcgaattggcgaaaaaacggcgcagccatgtgacaagcgccacaaagtctaacggcatttatcacgcgatgccgttttgggatgaagtctttcagcagacagccgctgattatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgatcggccagatttggacagcgaagttgatgctcgaccacttcggagaggaagaattgggggcgaaaattctggatgtaatggagcaagtgactgccgacggcatcaaaacacgcgacattgggggacaaagcacaacggctgaggtcactgatgaaatctgttcgcgcttaagaaagctctgatgaatcaggccggggcagatggctgccccggcctgtccatttccttacgaaaatttccacgaaagtctaaccaagcagatccaaatgctgtataataatttggaattcttaggaaagcatcgggtgaaggaagttgaatgcaaaaacaatcacgttaaagaaaaaaagaaaaatcaaaacgatcgttgtactcagtatcattatgatcgcagctctcatttttacgatcagattggtgttttacaagccttttcttattgaaggatcatcaatggccccaacgcttaaagactcagaaagaattctggttgataaagcagtcaaatggactggcgggtttcacagaggagacatcatagtcattcatgacaaaaagagcggccgctcatttgtcaaacgtttaatcggtttgcctggtgacagcattaaaatgaaaaatgatcagctatacataaatgataaaaaggtggaagaaccatacttaaaggaatataaacaggaggtcaaagagtcgggtgtaaccttaacaggtgacttcgaagttgaggttccttccggtaaatattttgtgatgggagataaccgtctcaattcactggatagcagaaacggaatgggcatgccttctgaggacgatatcattggtactgaatctctcgtcttttatccattcggtgagatgagacaggcaaaataaaatgcaatgcaaaaagaacatggaacatgacggcaccgataataaagcgccgtgcacgtttaaaaaaatgatgatgaaacggtgcggagccggctttccgccccgttttttatgatagaaagcgttttgaagaaaagggccctgttgaaataaacagaatcaggattggcgaagccgtgaagcgcatcgaattggtaaatctcaagatgggtatgctgtttttcccgcagttttttgataagaagcgctacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacactgaatccaatcacaaagatgtgccgtccggcgttttgtctgatcacattctggatgatggtttctcccgttttcagccgttcgtgttttgtaaattgttcgtatgccgttttttcttcttgcagtgtgtagacttcatcctcgccgagcaggttgggcgtcaacacatcatatccagccattttgatcagccggcccatctttttcatgtggctgtttacaccgtatatttcgtgtacgagaatgacaagcggttttggggacataacggcctccttttgtgttttttccattatatcctatcgtttcacttaaggctgagatataatggtcaaaaaaaggagatataaaatgaactcattatctttgcctcaccgctatccatttttgtttattgatggcgtgacggatagcgagcccggcaaacatgcgtcagcttataagctgattagtgtgaacgactggtttatcactgatacgcaaacagaaatgccgttttcacttgtgattgaagcgcttgcgcaaaccgcggcttttacaggaattacagatgagaacagcttgggattattgtcttcggtgaagaaagcggaaaagctgggagaagctgtgcctggtgaccggcttgatcttacgtttgaagtcacgcgcaatcggcgcgggtttgtgttcggacatgccaaggcgtcagttggagagcagcctgttgctgaagctgaaatcggcatctatattgaaaaatgaaaaaaacccttcacaacattttgtgaggggttctattttgtgtcgtaatcccgttcgctttgagagctatctctttgctggcgtttgtgtttttcatcattcatattttccttcagctcttcattaggaatcggatcggttaagtcgttgtgctcagggttttcatttggtttgttttgctgttttttttctgtcatgtttgatcacctcaccgtttgttttcctcttatccgttctcctcaaacataggaaatcgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgacgagcagctgatctcggatgaaaaccgcaaagccattcgtgaagcggaggataaaggtgtgtatgtggtgatcagcacgggccggacgctgatgacgtgcagggagctggcggaatcgctaaagctgtcatcctttctaatcacggcaaacggcagtgaaatttgggattcgaattttaatttggtggaacggaagctgcttcatacggaccatattcaaatgatgtgggatttgcggaataagcacaacactaatttctgggcttctacggtgaataaagtatggagaggcgagtttccggaaaacattacggatcatgaatggctcaaattcggctttgacatcgaggatgacgatatccgaaacgaagtgcttgaggagctgagaaaaaacaaagagctcgaaatcacaaattcaagtccgacaaacattgaagtcaacgcgcttggcatcaacaaagctgcagcccttgccaaggttacggaaaaactcggctttacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgatacgccattgggtactataaaaaaagagagtcctaagatggactctcttttttagtttggcaggttttcttctgggaccatggtaggttttctgacaaaagtatttcacaaactgatatgattcacttataatgaaataaagttcaaaaattcggaatagtcgttccggatttcgggacaataaatgacataaagcatatcgcttgctttggcaggagggattctgtgtttcagattgatttaaactgtgatttaggagaaagcttcggagcctacaagataggtcttgaccaagatattttagagtatgtgacatcagcgaatatcgcatgcggatttcatgcaggagatcctagtgttatgcgaaaaaccgtcgcgcttgcagcggaaaaaggcgtaaaaatcggcgcgcatccgggcttgccggatttactcggttttgggcgccgcaatatggcgatttctcctgaggaagcgtatgatcttgtcgtttatcaaattggcgcgctttctggctttctaaaagcagagggacttcacatgcagcacgtcaagccgcatggcgctttatacaatatggcggcagtcgatcaaaaactgtcggatgctatcgcgaaagctgtctataaggttgatcccggcctgattcttttcggtcttgctgagagcgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattaaaagcagatacagtctgcattcatggagatggagcccatgcgctgacatttgcgcaaaaaatcagaaaacagctcaaagcggctggaattgaagtgacagctatttcagaacagaagtcaacataaaggaggaacaatagatggagcagcagaaaaagacagcaggaaaaaaagcgggcagctggtcattgctgatgggcgccgcctttttaatggcgacatcagcaatcggaccgggtttcctcacccaaaccgcaacattcacaaacacactcgcagcaagcttcggttttgtcatcttaatctctattattttagatattttcgcccaaaccaatgtgtggcgcatcatcgcagtttctggaaaacgaggtcaggaaattgcgaatatggtgcttcccggactggggtatttcatcgccattctcgtcgtgcttggcggactagcttttaatattgggaatatcggaggggccgggctgggacttcaggtgctgttcggcattacacctgaaacaggcgctttaatcagtgccgttatcgccattttgatttttgtcatcaaggaagcaggaaaagcgatggaccgttttacgcaaatcgcggggttcgtgatgattattttaacggtctacgttgcggcgacgacagctcctccggtcggacaggcagtcgcaaatacattcgtcccggaacacatcagcatatttgccattgtcaccctagtgggcggaaccgtcggcggttatatcacatttgccggaggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacattgatgaaagcaacccggcggcctctgtcttcaaactggctgcaggaaatgtcggttataaaattttcggattgatcatgtggtctgcggcgattacgtctgttattggagcagcctatacatctgtttcgtttttcaaaaccttttctccaaaaattgaaaagaattcacgcggtattattatcggatttattgtggtttctacgttagcttttgtcacaatcggccagcctgcgaagatcctcgtccttgtcggttcactgaacggcttaattctgccgattgcactcggaacgctgcttgttgccgcctacaagaaaaacattgtcggtgattataagcatccgctttggctgacaagcacaggcgcgcttgtagtgattgtaatggcagttatgggaatctacacgttaattacacaacttcctcaattgtggagctgatataagtggagcaattaaacaaaatggcgccaaaggatgtacgcgccctgatacgagaggggaaaataaacgggccgaccgcaggcatgtccggcggctacgcccaagcgaatcttgtggttttgaaaaaggaccttgcgtttgactttctgctgttttgccagcgaaatcaaaagccctgccccgtgctggatgtgactgaagcaggttcgcctgtgccgtctctggctgcgcctgatgctgatatcagaacggactttccgaaataccgtatttacaggcacggtatcttaacggaagaagtatctgatattacgccatactgggaggacgattttgtcggctttctgatcggatgcagtttctcctttgaacaggcactgatcaataatgggatagctgtccggcatattgatgaggggacaaacgtctcgatgtataaaacgaatatcgattgtgttccggcgggggcgtttcacggacagatggttgtcagcatgaggccggttcctgaacggctggctgtacgtgccgcacaagtgacctcgcgttttccggctgtgcacggagggccgatgcatatcggtaatccgggagcaatcgggattcgcgatctcgggaaaccggatttcggagatgccgtttccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtaacctctcgtcatcctgatgaacgagaaataaaagaggtgagaaagatgactgtacgatatcaaatcgaacagctcggtgattctgcaatgatgatccgattcggagaagaaatcaatgaacaggttaacggcattgtccatgccgcggccgcttatatagaagaacagccatttccgggattcattgaatgtatcccggcttttacaagtctaaccgtattttatgatatgtatgaagtgtacaagcatttgcctcaaggcataagctcaccttttgagaaggtcaagcgcgatgtcgaagagcggctggcagaaatagccgaagactatgaggtcaaccgccgcattgtagaaattcccgtttgctatggcggtgaattcggtccggatttagaagaggtggcgaagatcaatcaactgtcaccggaggaagtaatcgacattcatacaaacggtgaatatgtggtgtatatgcttggcttcgcgcccggttttccttttctaggcgggatgtcaaaacgcattgcagctccgagaaaatcatcgccaagaccgtcgattcccgcaggttcggtcggtattgcgggattgcagacaggcgtttatccgatttcaacgccgggcggctggcagctgatcggcaaaacgccgctggctcttttccggccgcaggaaaacccgccgacattgctgcgggcgggagatattgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggagctatggacacggtttcactgcgcattgccaatctgttgataggaaacggcgaaaatgaagcaggtctcgaaataacgatgatggggcccggtccgtcgtttcatttttcaaaacagacactgattgctgtgacaggggcggacttcacgctgtgtattaatgacgaggaagcgcctttatggaagcctgtgctcatcaaggaaaacagcacggtcagctttggcccctgcaaactcggcagccgtgcttatttggcggcagccggcggcatcgaggtgcctgccgtcatggaaagtaaaagcacatacgtcagaggaagcatcggcggacttcatggcagagcgcttcaaaaagaagatgaactgaacattggagagatgtcagctctttcgcaaaccatcctttcccgcttaagttcgcagcttggaaatcagggatttgcagcaccgaagtggtcagtcagccgcggcagatttctgccattgaagaagaatcccgtcattcgggtgctggaaggaaagcaatttgcctttttcacagaagaatcaaaaacgcgtttttatgaagaagcatttcgtgtcacgccgcagtctgaccgtatgggctacaggctcaaaggagaaccgctcgaactgaaggccccgcttgagatggtgtcggaagcggtttcattcggaacagttcaggtgccgcctgacggcaacccgattatcctgcttgcagaccggcaaacgactggcggctatccgaggatcgcgcacatcatatccgctgatcttccgattgtttcccaaatcatgccgggcgagcacgttcagtttgagcctgtgtcccttcaggaggcagaagcgcttgcggtagagcgggaacagcatataaaagaactgaaaacgagaatgaagatggaatggctgacatagcaaaggggatgaatgatgcagaataaaaataaaaccgtagtcaaatctatggcgctgcttaatttgtttttgcataaaccaagcctaaccttaagtgaactggtgtcgctgacgggaatgccgaagacctctgttcaccggatggtcagctctttggaggaaatggggttcctcagtcgggatgcgtccggcgcttattcgctgggattggtgtttttggaattcggacagcttgtcgctgacaggctggatatcagaaaaatagcgaaaccggtgatggaagagctgtgccgggaagtggatgaggccgtgcagttgatcatgagggacggcaatgaagcgatatacgttgagaaaatagaagggacacagactgtgcggctgtatacggcgatcggcaggcgttcccccctatatgcgggagcgtgcgccagaagcattctgtcttttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggctgcgatcggcgccccgatctttaaccataagcgccaggtggcagccggcattagcattgcaggctttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatggtgcttcgatatacagctctgggcgattccttgacgacagggagaggctccgggctgttttcacccggcttcgtccagcgttttggggacatgatggaagctgacttgaaaacaagaacggcaataaacatatttgccagatcaggcctgaatacagaagagattttgggactcctgtcatatccctatgtgcaaaaatgcattcgagatgctgatatgataacgatcacagggtgcggaaacgatctcatcgattcggtcttagcctaccaaacctctaaggatgaaacgattttcagccgtgtatccgcccattgccatgagaattttgaaaagatgattgccaaaatcgccgagattaaaggagaaaatccttccccgtacgccattcgtgtgttcaacttatacaatccgtttcccgaaattgatatcgccggcaaatggatcacttcgtttaattcacatttagaaacacttgcatcagcaccccatgtcaaaatcgcggatgcctatagcatcttcaaaggcaaagaacaggaatatctgtcctttgacggtgtccatccgaacagcaaaggctatcaagcgatggctgaagccgttcacaagctaggctataaagaattatcagtttcatagaaaacgcgcctcatgacaggcgcgttttttatgtgtgatcgaaatattaaaagaaacttaaaattctctgtcttctgttctacagacaaacaaagtgcgctagaataatggagggcgtaggcaaatatagccataacgtttaatatttcgtatataaggaaggatggtccttttgtttcggatttttaaaatgtcttttgcggttatcattattatactggcgcttattgcttttaactatacggaacacacctctgttatccaatcggtcatgctcgtctttcttggtgcggtcatgtttatgcaggggcttgaagaacgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaaccgatgaagcaaggctttccactcttgatactctgaagaaccgcgaaagccttccgtatggtcctcaagtgtttcccactccacaagaagcagatatttatgcgtttcctctatgcattttgctaacgagtgagtgatatagcccttcatgccggaaataatcggcgccgcttgccggaatgcatcctcaaactcttgttcaaggccttctttaatgtgaagcattgctgcctccctgaccatgcgatcccttctttctgtcttttcgaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattgggttaatcggatgctccaaaacagattcaccagaggatcgcatggaagcattcgtgaaacagtggaacgatcagcaattcgatgacatgtatcaaagcctgactaaagatgtcaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgaaccgaaacgaggccaaatttacgataaaaatggaaaaggtttagctgtcaatacagatgttccggaaattggaattgttcccggagagcttggcgataaaaaagagaaagttataaaagaactcgccaaaaaacttgatttgactgaagacgacatcaagaaaaagctggatcaaggctgggtaaaagacgattcgtttgtgccgctcaaaaaggtcaagcctgaccaggagaaattagtttctgaagcgacgtcattacaaggcgtaacaagaacgaatgtcagctcccgctactatccgtatggcgaaaagacagcccatttgacaggctatgtccgcgccattacagcggaagaactgaagaaaaagaaagaaggaacgtacagcgatacgtctaacatcggtatcgccggacttgaaaatgtgtatgaaggcaagctaagaggcacaactggctggaaaatctacgtgccgcaaaccggggaagtcatcgctgaaaagaaagcaaaggacggcgaggatcttcacctcacaattgatatcaaaacgcaaacgaagctgtatgatgaactgaaggatgacagcggggcggcagtcgcgctgcagccgaagacaggcgaaacactcgcccttgtcagcgcgccttcctacgatccaaacggatttattttcggctggagcgataaggaatggaaaaagctaaacaaagataaaaacaatccgttttcagcgaaattcaataagacatacgcgccaggttctaccattaaaccgattgcggctgctattggaatcaaaaacggcacccttaaagccgatgagaagaaaacaatcaaaggcaaggagtggcaaaaagattcgagctggggcggctattcagtgacacgtgtgtctgagagacttcaacaagtcgatttggaaaacgcccttattatgtcagacaatatttattttgcccagaatgcgcttgatatgggagcggacaccttcacaaaaggcttaaaaacattcggtttttcagaggacgttccgtatgaattcccgatccagaaatcgtctattgcaaatgataagcttgattcagacattttgcttgcggatacaggctatggacaagggcaaatgcaaatgtctccgcttcacttggcaactgcttacacgccatttgttgacaatggagaccttgtcaaaccgacgctgatcaaaaaagattcacaaacagctgatgtttggcacaagcaagtggtcaccaaggaaggagcggcagacattacaaaaggtctgaaaggcgttgtggaagatgagcgcggatcagcgtatcagcctgtcgtaaaaggaatcacagtggccgggaaaacaggaacagccgagctgaaaacatcaaaagatgataaagacggcacggaaaatggctggtttgtcggctacgattacaaaaacaaagacctgcttgtcgccatgatgatccaaaatgtgcaggaccgcggcggcagccactatgtcgttgagaaagcgaaaaagcaatttcaatcgaattaaaatgtctttttaaaaggagcgaaaggaaaaaggggatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcaaatgctgaacttctgagtctcattgaatggtgtatcgatcatggcatcacgacctttgatcatgcggatatttatggaggctatacgtgcgaaaagctgtttggaaacgcccttgccctttcgcctggattaagagaaaacatagagttggtcacaaaatgcggtatcgttcttgaatcgcctgaacggcccgctcacagatcgcatcattataacacaagcaaatcgcatattttggcatccgttgagcaatcgcttatgaaccttaggacggattatatcgatatgcttttgattcacagaccggacccgctcatggatccggagggggtagcagaggcgtttcaggccttgaaatgctctggcaaggtcaggtactttggcgtttcaaattttaaagatcaccagtatcggatgctggaatcatatttgcctgagaagctcgtaaccaaccagattgagctttccgcatacgaattagaaaatatgctcgacggcactttgaacctgtgccaggaaaaacggattccgccgatggcttggtcgcctctggcaggcggcaaagttttcactggtgacacggaaaaagaccggcgtgtccgcacggcgcttgaatccgttcaagcagagattggcgccgcttcattggacgaggtgatgtacgcatggctgtatacgcatccggccgacatcatgccgattgtcggaagcggaaagcgcgagcggatttccgccgcgataaatgcgttgtcatacaagcttgaccaggatcaatggttccgcatttttacagccgtacagggttacgatattccataaaaagcatcagcttaccagctgatgctttttcaatattgtcacaccgcttagtgccaaattaccatttataagtgattgattctttcttgaaagcgttttatattaaaaggaaacctctctatatcctctactgcatctccttgcgacttcatccgcacatcaagattgtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgtggggcttacgttagataaacagcccggtaaagggttgaaagcagtgggaagtcccgaggataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgacttagatgagctcgagaagtggatttcccccttcggactgacactgatccgcaaaagaggttttggcatccagctcatagggccggagaatgcgaaacggaaaattgtcggcaacttgattgtgaaccgtctcgacatccaaatgtttttggaagcggttgaattaaacatcaaaggaaaagctgattcttcagagaaaatgttcggggttgtcagcaaaggcgagctgctaaaaatggagcgcatcttatttcagctcaaagaaaaaatcgctttttcattgtccgacagctcctatatagcgctcgtcgtccatctgacgtatgcgatcgaacgaattaagcttggggaaaccatcaccatggagcaaaatgagcttgaggaactgatgaatgcgaaagaatacagttcggctcttgaaatcgcgggcgagcttgaacgtgccttcggcgtgacgattccagaggcggaggtcggctatattacaatccaccttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggtgtcgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatccctgatcgagctaaaggggaaggatgttcaagcctatgatatgattgtgtccactgtaccgattccttatgaaaacattgattacatcatggtcagcccgctattaaatgaggaagacgcaaaccaggtcaagcagtatatcaagcggaagattccccttattcttaacaaaaaaagaagcccgaaggaagaggcgcagcaagctgatgtacctgacatgctagaggcggcggaaagcataggccggtatatggaagttatccaagatgttctgcgccattttacgctagctcaactcaaaacaaacccggaccatagcatgcttctgctagagctttttcaacagctgaagaaggatggcctgatccgtgatccggaaaaagccgcggtttgcctggctgagcgggagaaacaagggggattgggaatccccggaacaaacatggcgctttatcatctcaaaaatgatgaaatcgtcctgccttttttcaaaatgtttgatctcagcacctcctatgaagtggatggcatggacggaaataccctcaggatgacacgcattctcgtcatgatggcgcctagctcattatctgctgaaggctcggagattttaagcgcgatcagctcggcaattatcgagagcggagaaagcatggcggggtttcaggaagaaggagaacaagaattgtatcagcggttaaaccgcatatttttcacatggatgaaagaaaaaaacatactgtaaacctgcatggcacacgtcaaaaatttggcgtgtgtttttctgtggatggggaacaaaataagaaaatgtgggactattttatcattcagtattggaataattccaaaatgaaatagttttacaagttatcttttttgggttaaaatgggtgaggtaaggaagaaaatctaacaaattattgaagattcaagagaatataggagatgacgatatggaaacattacagcatctgattctgcatgacatgccgaatagcgaagaaatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcatcaactgttatgttcgccgcgcttgaaataggtgctgttgtcgtacctgtcagctggcagctgaaaccatatgaaatgacaggcattttaaaagcaagtgaaccgaaagcgatgttttacggagcggagtttaaagagatactggatgaagttctacctgaattgtcctcactgtgtgtaacaatggaaacaggaacagcttacgaaacatctgctgaatttgaagcgctgtttgcaggtcctgatcatttgccagagacggaaatggtttcacctgatgatacagcacttctgatgtttacatctggaacaacgggaaacccgaaaagatgcatgattacacatggcggcatatacagatacgttaaaaaatccaacagctcaatagcacgtatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttttacacgtatttgcttgaggcgtgggaaacgcaccaaactgacttatcttcacttgttattttaatgacaggcggaacaaaagtgccgagcagcctaatccgccgctatcttgatattggcattccgctcgcgcatggctatggaagcactgaggcttggggcatcagcacatggacgcctgatatgggaatggataaagcggcatctgcaggaaaacctgtggcaggtgttaaagtcaaagtggaagatcctctgaccggagaagaacttcctcaaggagaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattccagacccgctttacggtgaaaaaccgaaagcttttatcgtgaaaaatggcggccagcgcatcacagaagaggatgtcatcgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcacttgcacagacggaaagctcaggcttaatgttcttaaattgtatatcaatgtcttcgaagccggctgctttaaagtcagcaatcatctgtcttccaaatgatttggttttttcaggactggcatccgcttcccgcggctgcatcgtaatggctgctttgccgcctggctttaatgcccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcgcgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaaccccctttttgagttaatttcctcccagcgttccatgtgaaacatttttctgataaagcaatgcgaaggtgccaagccatgtttatccatagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgagaagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcatccgaaggaaagcatcaaagatattacgagcgaacagcttcaccgcacattcaaaacaaatttttattctcaattttatttgactaaaaaagcaattgattacctgaaaccgggcagcgccatcatcaatacgacatccatcaacccgtacgtagggaacccgacactgattgattatacagcgacaaaaggggcgatcaacgcctttacaagaacaatggcgcaggcgcttgttaaagacggcatccgtgtaaatgcagtcgcgccgggtccaatctggacgccactaatcccagctacgttccctgaagaaacagttgctcaatttgggcaggatacgccgatgggccgtcctggacagcctgttgagcacgtcggctgttatgtgctcctggcatcagatgagtcctcttacatgacaggacagaccctgcatgtcaacggcggaaactttgtgacgacataagagggagtgagacatatgagcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgccatccgccggtcgacggccaggaaggcaagcaggagaccttccgctgccgctacggaaaagtgtatctttacgtagaaggagaaaaaacgccgcttccaaaagttctccctcctcaggaagacagagaacactatacggtctggcacgaaattgagctagaaccgggcgggcaatacacgattccaccaaacacaaagcattggttccaggccggggaagaaggtgccgtcgtgacggaaatgtcatcgacgagtacggataaacatgatatctttaccgatccaagaatataaggatgggcttaacagcccatccttttttgtattgaaaaaaatagaatcatcgctataatgggtaaaaaaggaaagagggcgaggcaatgttcacttgcaaggtaaatgagcaaatcaccatccgattattggagccgaaggatgcggagcggctggccgaactcattatccaaaatcagcagcggcttggcaagtggctgttttttgcggaaaatccaagcagcgctgaaacgtaccgagaaaccatcattccagattggcggcgccagtatgccgacctgaacggaattgaggcggggctcctttatgacggcagcctatgcggcatgatcagcctgcataaccttgatcaagtgaatcgtaaggcggaaatcggatattggattgccaaagaatttgaagggaaaggcattattacagctgcctgccgaaaactcattacgtatgcttttgaagagcttgagctgaatcgtgtggcgatctgtgcggctgtcggaaacgaaaaaagcagagcggttccggagcggctcgggtttctagaggaaggcagggcacgggacggcttatacgtaaacggcatgcatcacgacctcgtctactacagtctgttaaagcgtgaatgggaaggtgaaaaataaagagcacactttcttgtttaaatcttccccggatgtggaaaagtaacagcggagacgttaaaaaggagtgattagagatgaatcagcaagacattaaacaaaaagtgcttgatgttctagatcaccataaagtaggttcgctcgcaacagttcaaaagggcaaaccgcattcccgctacatgacttttttccatgacgggctgacgatttacacaccgacaagcaaggaaactcataaagcggaagaaattgagaacaaccccaatgtccacattttattaggctatgattgtgaaggctttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattgatgaatgccggggagaaaacaccggtctcactcgaactataaaaaatttgtgttttcaggggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggcggatgatataatctttatttgcgtatagaaaagaataagacaaaccgcccggcgtacgccggacggtttttttattgcaaaaaacacatcgtactgaaacctccttgtcttctttccagtcttatctctaggatgaaattggaggaagaataacgtgcatgtcattacaacacaagtactttttattttttgttttttattgctgattcactcgatagaaaccttagcctatgctacaaggctttccggggcccgcgttggatttattgcgtccgcgctttccctgtttaatgtcatggtcatcgtgtccagaatgtcgaacatggtgcagcagccctttaccgggcatttaattgatgatgctggaaaaaacgcactggcgattgtaggggagcagttccgctttttaattttcggatcaacagtcggcaccattttgggcattatcctgctcccgtcttttgttgctcttttttcacgggcgattattcacttggcgggcggcggcggctctgtttttcaagtatttcgaaagggattctcgaaacaaggattcaaaaatgccctttcctatttgcgtctgccgtccatttcatatgtaaaaggatttcatatgcgcttgattccgaagcgtttgtttgtcatcaacatgctgatcacatcgatttatacgattggtgtgctttcggctttatacgcaggccttttggcgccggagcgcagcacgacagccgtcatggcttcgggtttgatcaacggaattgcgacgatgctgctggccatttttgttgatcctaaagtatccgttcttgctgatgatgtggcaaaaggaaaacgaagctatctctatttaaaatggacctctgtcacaatggtcacatcaagggtggcgggcacactcctcgcccagctcatgtttattccgggggcctactatatcgcgtggctgacaaagtggttttaataaaaaaggctggatcataaaaatccagccttttttgcgttcccttatttatatttccttaatccgcggtcgtacaaaaaatttccgaatgggacgaaagcggcgacgaagccggcagctgaccatttcagcggccatttgacagagaaggttgcataagccaagacaagcaaatacaaaatgaacaacccgccgtgaaccgaaccgacaattgtcaccgcaagcggaaggcctgcccaatatttaagcggcatagcgatgaacaacaggattaagagtgacattccttcaataaaacccatcgtgcgaagtcttccaatcggcgtgtgcagcataaatcgccctccttgtggacacgttttcattttatactataaacaatccggaggggcatatgacagctttcaaaaaatgttcggaaaacattcatttttacatgccttttctagggaactgtacttgtcatttacaaaaatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtcgcctccatctgtgacagaacgggtaaggcagcttgaatcgtttggcatcatcaagcaatacacgctggaggtcgaccagaaaaaactggggcttcccgtttcctgcattgtagaagcaaccgttaaaaacgcggattacgagcggttcaaaagctatattcaaacattgccgaatattgaattttgctaccggattgcgggtgcagcctgctatatgctgaaaatcaatgccgaaagcctcgaagcggtagaagatttcattaacaaaacatcgccctacgcgcaaaccgtcactcacgtcattttctcagaaattgacacgaaaaacgggcgcggttagagagtgccgcgcgaagtctgttataataacaggatgagcgcgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccagaaggctacggaaaagaatttcaatcatggcgcctagaggatctgccgattatcccagaacccttaaagcttgtggtaataaaaaaaaccggaaagcagttcaatacagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcagaagctgcgcagcggcaaagaatatgaaaacctgtaccattctgccgtcgccagagcggaagcggattggattgtggggatcaacgccacccgtgcacttaccacaaaattcaatgcccagctctcatgcgggcgtgtgcagactccgacgcttgccatgattgcaaagcgtgaggcagacattcaggcgtttacacccgttccgtattacggcatacgtgctgcagtcgacggcatgacgctgacgtggcaggataagaaatcaaagcagacgagaacgttcaatcaagatgtaacaagccgtttgctaaaaaacctcgacggaaagcaagcggtcgtagctgagctgaaaaaaacagcgaaaaaaagctttgcgcctgcgctttatgatttaacggagctccagcgtgacgctcacaagcgcttcggtttttctgccaaagaaacgctttctgtcctgcagaagctatatgagcagcataagctcgtcacatatccgcggacggactctagatttttatccagtgacatcgtcccgacgttaaaagaccgtctggaaggcatggaagtaaaaccgtatgcccaatatgtcagccaaattaaaaaacgcggcattaaatctcataaaggatatgtcaatgacgcgaaggtgtcagaccaccacgcgattatcccgaccgaagagccgctcgttctcagcagcctgagtgataaagaacgaaagctgtatgacctgattgcgaaacgtttccttgctgtattaatgcctgcattcgaatatgaggaaacaaaggtcatcgcagaaatcggcggagaaacctttacggcgaaaggcaaaaccgtgcagtcgcaagggtggaaagccgtttatgatatggcggatgaggatgatgagcaggaggatgatagagaccagacccttcctgcgcttcaaaaaggcgacacacttgccgtccgcacgttaacggaaacaagcggccaaacgaagccgcctgcccgctttaacgaagggaccttgctgtcagcgatggaaaacccaagcgcatttatgcagggagaagaaaaagacctcgtcaaaacgcttggagaaacaggcggcctcggcacggtggcaacgcgtgccgacattattgaaaaactgttcaacagctttttaatcgagaaaaaaggccaagatatttttatcacgtctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacatcacgggaacggcatgtccggaatgcggcaaaatgatgctgaaagtaaacggcaaacgcgggacgatgctcgtgtgccaagatcgtgaatgcggaagcagaaaaacgattgcccgaaaaacaaacgcacgctgcccgaattgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacaactgaaaaaactcggtttggataaataataaaaaaacctgtgcctattgcacaggtttttttattggacttaggtcctgttttcttaatgttcaaaaaggggaaaaaaagctagcaatctgcatttttttcttttatagtaaatgtactttgtaacgtggaagtcatattttcgtctataactatttgtgagcgtctgatttgcttcaggcgacaaagggggatttgcctgtgaggcatgtactaattgctgtcatcttattcttcttatctatcggactttccgcagggtgtgctgaagctggaaacaagacccaaaatcagtcggcgacagaagtgaaagtcagcccgctccagccggcggaatatttcatctatcacaatttaatgaatgacaaagggctgatcaaaaccgatttttcagaccagccttcttacttgtcggaatctctcggactgtggatggagtttctgctcagcaaaaatgacgcaccacatttccaggatcaatatcagcatctgactgattcatttctgatgagcaatcacttggtgacgtggaagattcaaaatggccaagcgagcgggacgaatgcgctgatagatgatatgagaattatgctgtctcttgaccaagccgccgcaaaatggggccgcagcgactacgcgcaaacggctagggatatcggcacgtctttgaagacatacaatatgaacaacgggttttttacagacttttacgactcacaggccgcttcaaaggatgtgacgctttcatacgtcatgcctgatgccttagctgtcttaaagaagaatggaatcatagacgaagaaacagaacagcggaatgccaatgttctctattcagctcctttaaaaaatggctttctgccgaagacatacagctcggagacgaaggaatacacatatgatagtgaaatcaacctgattgatcagctttacgctgcttggcatttgccggaaggggatgaaaaagcatctgttttagcggactggatcaagcaggaatttcagaaaaacggaaagctgtacgggcggtattcggcatatacgaaggagcctgccgtccaatatgagtctccatccgtatatgccttagccgtattgtttttgacaaaacagcatgaaaacagttctgtcatcaaagccatatatgatagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctttgtttatttattatgtgtcagcccagcaatcagaaggtgctctgatcctttgcatcacatttggcgtcatcgccgcaggcatctggttcggcccgatttacgcgctggcagtgaccttaatcgtactctttgttctcggcaccttaatgatgtttttccagactggacagacatcgctctttccggctgaggaagggctgcgaatgcttgtcgtgtggggaatcgcgcttttgctgttttcttttatttctggaagaatccacgatattacagcagagcttcggcgctcgattacacggcttcaatccgaaattaaaagctatgttgctgttgacagagtgaccggttttgataacaagcaaagtatgaagctggaactttcagaagaaatcaagcgggcggagcgctatggcaattcttttgtgtttttgctgctccatatgcattatttcaaagagtttaagtctttgtacggtgaaaaagaaacggaccgcctcttccaatatgtcggtcagcaaatcaggacaagcgttcgggaaacggataagaaattccgtccctctgacgagcgtatcgggatcgtgctgacgcacacgcctgctgaacatatgccggccgttctgactaagctgaagaaacaattggatacatatcagctggaaaatggaaagtatgtgtcgcttacgttccacgtttgctatttgccctaccgcaacgatatcaaaacagctgatcaatttttagaagaactggaaaacgagatgatgatgaatgaactataaaggaatcacattgctatgcgtcatgatgcttctagtttcagctattgcgtcttttcccgtttctgcgcaagcgaaagatcaggacgccggtattttcatcatctactcaaccttggacggcaaagagtcgtcacaagtcaaaatgctcgatttgcttgcgggccactttacatcccatgtgacagtcaaaaaagattcagacgttgaagcgtcggatttcaaagggaaagaccatgtgatttattacggccaaacgaaaagaaagctcagcaaaaaactgctgtctcttatcagcggcgtaaaaaaaccggttgtcgccattggctataacgcaggtcaaatcagccaattttccgggctttcattagcccgcaaagaaaatgtgtttcaggttcacagcaggtcggaaaaggccgatgtgtctctggaaagcgggcttaacgtgctgagtgtatcaggcctgaaaggaacggcgctttacaccttcaaagccgatgacggcacaacgcattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaactgctgcttcaagccggtacatacctgcataagcggcatattccttttatcctggcggtcattccggtttacttgaatccggaaacaggcgacaaagtgtatttgtctaatcaaccgaagatggtcaaggtgctgaagaagctgcaaagcatgggcggcagtatcatagttcacggctatactcacgcttatcgctacagtgaaacaggagagggatttgaattttgggatgcaaaggcggatcagccgattacatccggaaatgccgaagaccccccgtccattttggagaaagaacaggacttcccgaacgaacaagcctatcacagctatcttgaaccatttcgggaaaaggaagaaacgtatacaaaacaaaaactgacgcgtgccattgaggatttgacatcatcgggtctttacccgctggcgtttgaagcgccgcattacacgatgtccgaatatggctatcaaatcgcctcgcagtattttacaagcattttcggccaggtccagctcagcagcacaacatggaaaacatccggtgcacctccgtttgtgactgctccttcgatgctgcacggaatgacgctttatccggaaacgatcggctttgtcgacacatcgaagcaaaacccgctcggtgagatggaggagcatatctcccagatgattgattttgaaggcggagtagccggaggattttatcacccgtaccttgggatgaaatatctgcctgagctggttgatcagatggaacgcattccagacagtgaatggcttgatttaaagaaaacgaaacaaaccgtcaaaacagacaaagtggaaattcatacaagcggtgacggaacgattcaggtgaaaaacggcgtaagccccatttacgagtttttcgatcatcaccggcaaacccctctggaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgttcctcatgcagggcgggtttcgccactatatgaccttcgaacggaatatcccgaagtggagagaaaatatgaaggaactgccgaaggtcagcgtcctcatcccggcgcataacgaagaggttgtgattcggcagacgctgaaggccatggtcaacctttattatccgaaggaccggctggagattatcgtcgttaatgataattcatcagaccggacgggtgatatcgtcaatgaattttccgagaaatacgatttcatcaaaatggtgattacgaagccgccaaatgcaggaaaaggaaaatcctctgcacttaactcgggttttgccgaatcgaacggcgatgtgatctgtgtgtatgacgccgacaacacgcctgagaaaatggccgtgtattacctcgtgctcggcctgatgaatgacgaaaaggcaggcgccgtggtagggaaattccgcgtcatcaatgcggcaaagacgctgctgacgaggtttattaatatcgaaacgatctgttttcagtggatggcccagggaggcagatggaagtggttcaaaatcgccacgatcccaggcaccaacttcgcgatccgcagaagcattatcgaaaagctcggaggctgggatgacaaagcgctcgctgaggatactgagctgaccatccgggtatataatctcggctatcacatccgctttttccctgccgccatcacgtgggagcaggaaccggaaacatggaaggtatggtggcgccagcgcacccgatgggcgcgcggcaatcaatatgtcgtgctcaaatttttggcgcagttttttaagctgaaacgaaaacggattatctttgatttgttttattttttctttacgtacttcctgtttttctttggcgtgatcatgtcaaatgcgatttttgtagtgaatttgttttatgatttgcatttgtctgttggatttttggcaatgattctctggattttggcgtttttcttatttatgacagaggtcatgattacgttgagcattgaaaaaacagaaatgaacaagcaaaacttttttatcgtatttctcatgtacttcacatactcgcaggcatggattgtgcttgttatctactctttattcgtagaaatcaagcaccgtttattcaagcaagaggtcaaatggtacaagacagaacgatacaatcaacataaaagcgggtgacctttttgaaacaaataatgatttttctcacaagcttcatgctgctggcgatgactggacaaacggctcttgccaaagacgtacaggtcagcggttcgctccttgggaaaagcagccaagaacaagccaaacagcaggtgctgacaagcgagctgattacactgtatggatcaaaagacagcgcagagctgacgtatcagatcccggcaggcgcctcttcgggcaatcagcaattggtaatcgaatacgaggcatcaaatcttttaatttctccatcatcgttaacggttgtcattgatgatgaaccggtcaagacgttaaagcttgatggtgattccaaacggaaaacagtgaagctgaatctgaataaaagccagtctgcgcaaggctatcacaacgtatcgctgaaattctacggcgtaatgaaagagggcgtgtgcgtcagacaggatacatcaggcaactggatcaaaatttatccggacagccggctgacacttgctgacagcagtgaagcgaagggaacgtcgctggaccattatccgtatcctttcgcccaatctggaaatacagcggaagaaacagctatcgtcattccggataacccaagttcagcagaaatagaagctgctgttaaaacagaaggctatttgaaaacggtggacagcagtgtcagtattgcgtatgtcacggaatctgaactgaaaaaaatcgataagccgacgattgttatcggcgtggacaagcattggaacggcaaagtgaaaaaactgttgaaacaagccgggctacaggcaaaaggagaaaaccttctgcttgcggagcgggtgctgaaagcagagggcaaacagcagccggttctgtttgcgcaagcggcgtccgaggacgcgctcacaaaaaaaatcagcgtgatgacagatcagacatatacaggccagctcagcggcgatacactttcaatcagcaagcttcagcagactgaaaaaaaagaaagcgataagctgacccttgagaattttggagcgggtgatatcacaattggagccgacaaaacatcttcagcacattatttttatccggcttcggctgttttagatgaaaaccaatcggcgaagctgtcgcttaaactgaaaaagtctgaaacgattcaagcctcaacggctgaaaacgagtcagcctctcaggctgcagaactgaaagtgatgatcaacggccagccgcactcggtccggcttgatgaattaggaaaagaagataaaaacggattctatcatgtcacagtgaaagtggaccctaagctgctgcaaaaaaaccgctacattgatattcagttcgtcacgaccggtttaaaggaaaacaacccttgtaacaccactgatgaagaaaagtgggtttttatcgataaaaacagtacattatcatacgccatcaaaggcatgtccccgtcagcggattttcaagagtggccgctgccttacgccggaaaccaggatcaaacaacgttaatcgtgcttcctgacaccgtaagccaatcgaagctagaggagctttctctcgtaacagaatcctttggcaacgaagcacagcattcatatacggtaaagaaatcatctgacgttacagcaaatgatgcgaaaggacgaaacctcattttcataggagggatcaatcaattttctcttctgaaggagaaatcatcagatctgcttgtgccgcaggaaaagaacggctcgtttgatgtatctagtttcgagatgctgaatgagacgacaaaacaagtggtatttacccaagcatcggtttgggattcacgctatacaatggctgtctttgcaccgtcaaaaggagatggcacggctgtcacaaaagagatcatcagttatctgaacagcaacgatgagtcggcaaccgtccttaatgaaacaaacagccagcaggtgtttacaaaccaccagcagctcaaatcggaaacaaacagttccgatgcagaacaaccaacacaggatcatagccagaaatggatgtatattggtgtgctggcactcattatggtggttgcggcagtgttcatttggattgccgtaagacgcaaaaaaagaaagacagatacagaataaaacagaggcgattttagcctctgtttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcaacaacatgtgagagcaagacactgatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctgtcatctgtcgcatatgggacagaacaaattctaatcattttggcaacaatcagtgcagccgcattttggtactccattccgattgcggttggcgttctcatcttgctgctcgcactgattctttcatacaggcaaattatttacgcttatccgcagggcggcggggcgtatgtcgtttctaaagaaaatctcggtgaaaaaccgggattgattgcgggcggttcattgcttgttgattatattttaacagtagcggtaagtatttccgcaggcacggacgccatcacgtcagcctttcctgcattgcatgattatcatgtgccgatcgctatttttctcgtgttagtgattatgattttgaacctgcgcggtctttcggaatcggcatccattcttgcctacccggtttatctgtttgtggtggcgcttttggttctcattgcagtcgggttgtttaaactcatgacaggacaaatagaccagccagcccatcatacaccgctgggcacacctgtagcgggcattacgctgtttttgctgcttaaggctttttcctccggatgctcagcgttgaccggggttgaggccatttctaacgcgattcctgcattcaaaaacccgcctgcgcgaaacgcggcaagaacgcttgcgatgatggggattttgctggcgattctgttctccggcatcacggtgctcgcgtacgggtatggtacggcgccgaagcctgatgaaacagtggtttcacaaattgcgtccgaaaccttcggacggaatgtgttctactatgtcatccaaggtgtcacatcgcttattttggttcttgcggcaaatacgggattttcagccttcccgcagcttgccttcaacctggcgagagaccagtatatgccgcgaatgtttacagtcaggggcgaccgcttaggcttctcaaatgggattatctttttaggctttgcctccattgttctcattatcttattcggaggacagacggagcacttaatcccgttatatgctgtgggcgtatttattccatttacgctttcacaaaccggcatgtgcatgaaatggatcaggcaaaaaccaaaaggctggatcggaaaaatgctgatcaactcctgcggcgcactgatatcgtttatggttctatccatcctgtttgtgacgaagtttaatgttgtatggcctgtgttaatctttatgcctatagtggttttgctgttttttgcgattaaaaatcactatacagcggttggtgaacagcttcgcatcgtagacaaagagccggaagaaatcaaaggcaccgttgtgattgtgcctgtggccggtgtcaccaccgtcgtgcaaaaatcgattcactatgcgaaatcactgtccgatcaagtgatcgccgttcacgtgtcatttgacagagaacaggaaaagaaattcgaaaaacgctgggaagagcttaataacggcgtgcgtctcgttacgcttcactcctcgtacagaagccttgtccatccgtttgataagtttttggaaacagttgaggcaaaagcgaagaaggagcagttttccgttatggtgctgtttccgcaatttataacgaaaaaacgctggcacaccatccttcacaaccaatcggccttcctcctcagagtccggctgttctggaaaaaggacataatggttgccacactgccgtatcattttaaaaagtaaagctctaggaccaagggaatcaccttggtccttttttgcgggaaaaggaggtatgacggtgtatacacaaggtgcttttgtgatcgtattgaacgaaagtcagcaaattctgctggtgaaacgaaaagatgtccctctatgggatttgccgggcggcagggttgatcccggggaatcggctgaggaagcggcagtgcgggaggtattggaagaaacgggatacaatgtagcgctttctgcgaaaataggtgtttaccaaaggccaaagtttcaagatgaacagcatgtgtttttcggaagcataacaggcggacaagcagtggctgacggcacagagacagcgggattaaagtgggtttccccggagcgtttgccgctttttatggtgccgaaccgaaaaaggcagatcaatgatttcaagaatggcgctcaagatgtaaatgtcaccgtcaaggatagagggttgctcgcggcgatcgacctgttgaaaagaagacttggcaagtgattcaggtctccgggttttaaagcctttctcctgtggtattgaaaaaaggaaaaaggaggatacgttatggcacacaaaactgcaggacaagcaatgacagagctgcttgagcaatggggagttgatcacgtatacggcatccccggagacagtataaatgagtttattgaagaattaagacacgaaagaaatcaactgaagttcattcaaactcgccatgaagaggtagcggcactggcagccgcggctgaagcaaaactcaccggcaagatcggagtctgtctgtcaatcgcagggccgggagcggtgcacttattaaatggtttatatgatgcaaaagcggacggcgcccctgtgctggcgattgcaggacaggtttcttctggcgaagtcggacgggactatttccaggagattaagctggagcaaatgtttgaggacgtggctgtgttcaacagagaggtacatagcgcagaatcacttccggatctcttaaatcaggcgatcaggaccgcctacagcaaaaaaggcgttgcggtattgagcgtgtcagatgatttgtttgcggagaaaatcaaacgggagcccgtgtatacttcaccggtgtatattgaagggaaccttgaaccgaaaaaagaacagctcgtcacctgcgcccaatatattaataacgctaagaaaccgattatcctggcagggcagggaatgaaaaaggcgaaacgggagctcttagaatttgcggacaaagccgccgctccgatcgttgttacactcccggcaaaaggtgtcgttcccgataagcacccgcattttctcggcaacctcgggcagatcggaacaaagccggcttacgaggcaatggaggaatgtgatttattaatcatgctcggaacatcattcccgtaccgtgattatttgcctgatgacacgccggcaatccagctcgattcagacccggcaaaaatcggaaaacggtatccggtgacagcgggccttgtctgcgattcggctctcggtctgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtagcccgtcttcaggaagcggcagccgatgatgcggtgctctctgtagatgtcggcactgtgacagtctggatggcgcgtcatttcaaaatgaacgcgaaccaggatttcatcgtctccagctggcttgcgacaatgggctgcggcctgccgggagcgatcgccgcaagcttgtccgaaccggaacgccaggcgatcgctgtctgtggtgacgggggattttccatggtcatgcaggatcttccgaccgctgtcaaatataagctcccgatcacagtcgtcattttaaacaacgaaaatcttggcatgattgagtacgagcagcaggtcaaaggcaatatcgactatgtcacaaaacttcaaaatgtcgactatgccgcatttgcagaaagctgcggagcaaagggcatcaaagtgactaaagcggaagagcttgcgccggcattccatgaggcgctgcactctgaccaacctgttgttgtggatgtcatgattggaaacgaaccgccgcttcctggcaaaatcacctacgggcaggcgaaaggttttagcaagtacatgctgaaaaacttcttcgaaaaccaaaaatttgaaatgccgtcactgaagaaaagtttgaaacggttattttagtgaatataactaagggttattgggataactcccaataacccttttaattaaattgaaaaacctatttttagatttagatgtcgactcataggatcatagatgtattgtaagaaagtgtttacatataaaaaaatgatatgttattatgtccttgtatttccaattttttaaaaaggaggaactataaggctaagtgtttcggtcgataaaaataagtataaggggaattagattatgaaaaaaaagttatttagtacaatttcaataggggtattaggagtaacattttttgcgaattcttatacaacgcaagctgcaccagagcatattaaacaggtaaaacatattgaattaaatactggtgaagatgaatacacaacaaaaaatgcatttgctgctggagttgctgccggtattgttagtgcagcagtttatgatggcattaaagccgctggaaattggttgggaaaacaagcaaacaaagctaatgcacaatctatatatagtgcagctcctgctagaaaatatgcatgttatatagtgaatcctcaagatcacaaggatattgatatttcagaagttgcggaatttggtaggtaaaaaggaaggggcctcccttccttttcaaatggaggttgtataatttgaagacaaagaggaaatataatttacttgttttgttcctttctttattagtagtattccatacaataataatgataatgtataacttgccgttaaatcctgttaactttaagcatgagaaattaatttcaacgtatatgaatccattatttactcaaaactggcaattatttgccccagatccggtaagcacaaataacaatattatctgcaggggggtctttacaaataataaaggacaaaaagaatatactgagtggatagatattacagaaagttataatgcagacattaaaaacaatttattttcaccaaacagattaatgaaaactgcgctttctggtgctgtctttgaggttcaaccgtatctaaagctgaatgataaaaagaagaataaacaattaattgagaacgagtacatccaaattatatctagtatagctgtgaaaaaaatagagagaagtaagaaagtaaaattagaatcattagatgttaagttgtctatagaatcgtttcctgagtatggaaagaaggggaagtcaaaatttaatgtacagcagttcccccatatcaatttactaacaaaggaatgagatttaatttgaaaattattttaaataagttcagaaattttaatcatttaatgtcaaataaaatgcattatttaataggttcaagcatcttaaggatatttattggattacatattatgtttacttatttaattcactttgctcaaaggaatgaaatatggggacctaatgctttttattcatttgaaaaatgctttgaagcttatggttttacttctctatatctttttagtgactcacagttatattttgagtttatttttataagtggaatagtcattaatactctgtatatattagggtataaaatgagagtagtcagcatcataaattttatttgggtttggtctttatatcaaaggaatccttacatacatgacggtggtaataatattcttattcttattatgttgtatcttatttttgcatccttaggtgagttttttactattcatactgaatcccgttcgaaagaaaagtctaaagttactattattattcacaatttctcagtgatgatttcaatgattcaagtgtctttactttatttttttgcgggctttaacaaagcgcaaggaaaaatgtggacccatgggaccgcactttactatatactacaggttgatgaatatagtataaacaaagggtttacaaatctcgttattgataacccttatcttctagtattaggaacatactcagcattgtttctccagctaatgtttccaatattagtttggaataggtattttaaaattcccctgcttataggttcaattctttttcatttatctataattatatttatgggtcttcttcaatttggtgttataatgatagcccttgatttattgtttataacggatacggagtataggaaattgtacaagtttttatcacgaatttatgataagtttaaactgaagtttaggaatattttcaaccaaaagttaagaaatcccaccatttaaaatatcgtttaaatgttaatgtcagactgttataattattatgtcttttcaatccaatttagggggaaggggttttatgtttgattacattaagattattatttatttaatcggatcaattggaatgatctacgcttgttatcacgattataactatgcaaaaaaaggacaaaatgacaagtgcatatttttcaaaaataaacgattaagtggagtagtgctattttgttatttgtttttatttttagctaatcttaaggacttcttgtttttgttaattaacacgaaataaatacaattgtatagttaaaagactgtcgatgtgagtcggcagtcttaattttacctagtcaattatttttgtccttgtatgtttattcttatcaaatcttacagaactcttctcattataagcttatttctcttttttcttcagcccgaagaagaaaggaaaagcagaaccgaccaagaaggtgccgaataaaaacatgccgccgataaacacgtggaaatttgtgtgtccggccgtaaacgccgtgattaaggaaatgatactgagcacgatcatggcaatgccgggcgcgactctcatttttcccttggacttatgggcagcaacagaacataaaatgccgataacaataggaacaatccacaaataaaacagaataaatactgacatcatcaaaactccgatttttcttctatcataacaaatttctgtcaaaaagggtatcaatgagcttttgcgaaaataataaaaaccggctttagaagccggtttttttatcgaaacgtatctacaattaaaaacacattcaaagcaacgatcaatacagcaatcagccaagacaccactgtgacccatttggcgttgatcagagatcccatgatccgtttattgcttgtaaacataataagcggaatgagggcaaaggcgatcccgaatgacagcacgacctggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacatagggctgacaagatgtccgaattgctgaaatgcgacgtcaagatcctcaacaaacaggccgtttttgaagaataatgcagcagccacaatcagcatacttgcattaatagcccctgcaatcagcatcgctattaaaatatcaataaattcaaacctaaagatttttttccgttctgcatcagttttgccaaccacccgccgttgtgtaagggcagagtgtaaataaatggcgtgcggcataacagttgcgccaagaatacccgctgcaagaagcacactgtcggtgccatgaaacgccgggacaaaaaggcccttcatcactgacacggcatcaggctttgcgaaaaaggtctgcagcgcaaaggcgatcacgaccacaaacagcataccggcaataccggcttcaagtgagcgataaccgcggcgctgaagctccaatatcgcgaaagaaccgatcgccgcaataatagacgcttcaagcatcggaatgccgaacagcaaatacagtcccagagcagctccgataaattccgccagatcagttgcgataatgacaagctcgccctgaatccataatccgatcgagacaggctttgggaattcttcacgggcaacctcaggcagatttttgcctgtcgcaataccgagtttggcggatagggattgaatcaaaagcgccatgatattagaaaataagatcacccataagagcatatatccgtatttagaacccgccgaaatattcgttgcgaagttgccgggatcaatataggcaatggctgctataaatgcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttaaggcaaattattttatctacatcatatgaccatcccggtttcttgtcaaccgaaaatgttcaaaatacacttctgaatttttccctgttatgtaacatgatatgtagggattcgggataaggtcccatataaaaagacatcgtttcagttcgaaacgatgcctcctgtatctaatgagtcgagtctaggcttccttccgcagcccgcggaatataaggcctagcaagaacacgaagatggctgccccgatgatggccgggaaaatagcaaagccggcgaggctcggtccccatgtgccaagaagtccgtgcccgatccaagcgccgatcagcccggcaatcatagagccgaaaattcctcccggcagccggtttcctacaatggcgctcccaattaatccgataacaattgcaacaactaatgaaaccaaaaagctaagcatcatgatcacctctcataaatgatttaccaatcaataaccgctcctgatcatttcgaaacacctaaaagcatattcctttatgatcctgttttaatctttctctgcacactgccgtcagctaaatgaacaatgacctcagtgcctttatgcgccgcgatttcctttgcccgttcaatcgcttctttctttgtatccttgatttcagacacacgtttggcgccctcggctttgactgcccagccttttttatgcttaataacatgctctgctttattcatgagctcggggccgctgccgctgcttggatcagcatcgcgttctgtctcatcatcatgcgtcaggaaatcatcaatttcatctgtagaggcgttttccgcccattccttcgctttgcttgtcgcaattggaatcgcgcgcccttcctcatagccttcatcaatcatcgcattcgcaatgtctatcgccttttttctcaccggcttctcaagattttttaatgaagcaggataatccttcatcgaccaaggcatgtccatcactccttttccttttataaaaatggtacccgcaggtgaaaaataaaaacgcatccgaaaaaatgaaggtatactatatagtagaaaaaacggaagggaagtgcgggttgggtgccaacagaacgaaaagaagacttacatcagcaattaaaagagatagagaaatgggaaaaagatcagcaaaaagtctggttttgggaaaagctcagccgtctcccgtttcaactgctggacaagctgacaccagaattcatccagaaaaagatcggcaagctcttggatgaggtcggcagctttgttcaaacaggcggacagtacctgacatctgaaaaacagattatcaggatgtttcaaaagaaactgccgggggagatctttgaatcgctggaggacatccggaaagctcctcttcctgtcatggatgaaattgcggaaggaatgggcaaaaacagaaccaacgcagcaaccgttcaaggtgcgacaaccggtgtgggcggcgtgtttacgctggcggcagacattccggcagtgcttggcttatcactaaaaacattacaggatatcgcagtcgcatacggctatgacccaaaggagaaaaaagaacgcgtcttcattgtgaaatgcctgcagctgacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagcagaaagcagacggacaccgcgatccgcctgctttttttagtggaaacatacccaatgtgttttgtttgtttaaaagaattgtgagcgggaatacaacaaccaacaccaattaaaggaggaattcaaaatggcagacgataacaaaatgagcagagaagaagcaggtagaaaaggcggagaaacaacaagcaagaaccatgacaaagaattctatcaagagattggtcaaaaaggcggagaagccactagcaaaaaccatgacaaagaattctatcaagaaatcggcgaaaaaggcggagaagccactagcaagaaccatgacaaagagttctatcaagaaatcggtgaaaaaggcggagaagccactagcgaaaatcatgataaagaattctatcaagaaatcggccgaaaaggcggagaggcaacaagcaaaaatcatgataaagaattctaccaagaaatcggctcaaaaggcggaaacgcccgcaacaacgactaatcaaaagcataaaggcagacaacctgtaaataaaaaagcgatccggcacatcagctggatcgcttttttttggaatcttctcaatttatgccgctattgagatacaataagtgaaaaaggggttttcgctaatgtccaagatacaaaacttgctcgccatcgcaaatgaagtcaaagaaaagcacgccaatttttcaatctcagaggtcaacgaccactgcgtgcgcattgcggtgtttacgggagaatatgactggcaccatcaccctgactcagacgaattgtttattgttcttgaaggggagctgctgatcgattttaaggacaaagaaaccgcggtgctcaaagcaaatgacagcctgctgatcccgaaaggcacggttcaccgcacacgctcttacgtcagaacggtaaatctctgtgtggagcataaacaagccgaaaccgtcatcatagaggagtagccatgctaatcaaaaagatgatatgtgaagtagacgctgcaaacgctgaagcatttgcaaaagcgcagttacagtggggagcattatcgcatataagcggctttatcaaacaggccggcggctggcgaaaaacgaatgacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgttcacgatctgttacataaccccgatatccggtacgaaccaaactggacggttctgaaggcataatcaaagcccaaaacatcatgttttgggcttgtctctttactcgcgtcccggaagtgtattatgaacataaggcggtgctggttttaactccggtttttctccaaacgtttttgcctctttcacatattcaaaggcttctccgtccggcgctttttcattcagccagttttgctcggcgctttcttcgccttcagagaaattgataagctgatgtgagaactcttgtttttcgagcgctttcgggaatgtacccggcacaaccggaccttcctgtgcttctaattctttaatggcggcgagccattgattttggtgcattgtgtcacgcgccagcaggaagctgagcatatctttgacgcctttgtcatccgtcatttcaaacaggcgtgcgacctgcagacggccctgagattccgcattcaggttggcgcggaagtctgccagcaggtttccgcttgctacgatataaccgccgctccaaggtacgcctgtactgctttccggcatggcgccaagtcctgatacaatcgcatggtgagggttcatgccgcctaggatggagccgatgaccggatcttcagcagctttttcctgctgatcaagaggggcatcctcaagaagtctggcaatcatcgttgcgatcatttcaacatgcccgagctcctcagttgccgtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgattatctctttttatatttccgatcgatagaaagataaacgaaaaacagcgtatcgagatgggaactatgaatcttttcgcagctccaacagttcccggatcagctcccggccgaagatgggctcatactgccggtaaacagggtcaagacgcttcatccattcttgtttctctttatctgacagctcataaatatgtatagcagaattctttttgatttcttccagctgctccttgttcatttgttcggcatacgtttcattccaatccgtcgtctccttcatcgcttcagtcaaaatgcgccttgtttctggtgtttgcgccttccagaagtgttcatcggtcatgacagcgtagccgagataaccgtggctgcttattgtcaaatagtcctgaacattataaaattttttagaatagatgtttgaaattgtattttcttcgccatcgactacattgttttctaacagctgaaaggtagaattgaaggattcctgatgaggtgttgcgccaagcagcttgaactgatcctcaatcacatcgctttgcataatgcgcagatcctgcccttttaaatcatccggtgttttgaccggcccttgatttgttgtgatttgcttaaagccgttcgtccaataggccagtccttttaattggtttttctttagagaatcaaacagctgtgtaccgatgcttccgttcagcccttttttgacggcgttgtaatctgtaaatgcatacggcagatcaagcactccccattcaggcgagagcatgccgagcttcgatgtggagggggcgataaattgaacatcgccgttttgcaatgcttcaatttcttcaatgtccgagtacaggcttccattcggaaatacttctatttttattttcccgcctgatttttcgttcaccagatcagcgaatttattggcggccagcccttttggcgtattttcagcaaccacgtggctgaatttaaacacgatttgatcctgcaggccttcctggtcgtcatcataaacaatctttttattgccggtatgatcatggaatccgataaataaagcggttgcaattccagcgatcatcagtgcgagacatgcaagcaaactcttcatgaaaagccctcccctatgttaaggataatgggggcaatgacattcgtaaagacctgaaaggagaagctgatgaacaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggactgtgtcagagatgacagaagtgaaagaagccttggcgcgaaaaaaacaaacagaagctgttcgccatgcggttgaagaaatcaggatgattaatgaagcagactatattgtcgtcatggatatgaatcacatccgatatacgcatcctgtcagcacaagcattggcaagaaatcagaaggtgcagacgaggaggcagcttttgcggagcacatttatttctctgaagcaaagggcgagatcggcacggcggttcgcgctttttatccggtaaaggatcaagacctgaaccaaataggcgtggtgcttgtcggaaaaacgctgccggggatcgctgacatcctgcttcatttaaagcgtgatatcgccttcatcgttgtgctgacactcggcttcggccttgctggttcctttttgctggcccgccatatcaaaaaacaaatgtttcagcttgaaccccatgagattgtccgaatgtatgaagaacggacagcgacgtttcactcgatgaatgaaggggtgatcgccattgacaatcgtctcatcattacgatcttcaatgaaaaagcgaaacagatctttgaagtgcagggggatctcatcggcaaggtgatttgggaggttctcaaggattcgcgcctgcccgaaatcgtggagcggaacaaagcggtttataatgaagaaattcgtgtcagcggaaaagtcatcatgagcagcagaattccgatcgtcatgaagaagaaagtgatcggcgccgttgcgatttttcaggacagaacggaagcggccaagatggcagaggaattgactggtgtcagaaactttgtggaggcgctccgtgtccaaaaccatgagcatatgaataagctgcacacgatcgccggcctcatccagctggggaaatctgaaaaagccttgcagcttgcattccaggcgtcaactgagcaggaaaatgtgactgaatttctgcaccgctcgattcaaaatgacgctgcggcaggccttctattaagtaaaatcagaaggggaagagagctcggcattgctgttcatatagatgaaaacagcagtcttcagcaatttcccgagcatgttgatcagcatgatattgtcgtgcttttggggaatctgattgaaaatgccttcggctcatttgaaaccgttcaatctgaagacaaacgaattgacattagtatcgaacaaacagatgatatccttgctattttaatagaagataacggctgcggaattgaaccggcgcatatgcctcgcctttatgacaaaggttttacggtcaataaaactggcggcacaggctatggcctgtatctagtgaaacaaatcatagacaaaggatcgggcacgatagaagttgattcacatgcggggcaggggacatctttttctatcgtttttccaatgaaaggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgattaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaaggaaacgatctcactcatgctgcaaaacggggcgattgactatatcttaaagccgtttaagcttgagcgaatgagacaggcgctcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggttgccaaggcgctcggtatcgccagagtgacagccagacgatatcttgattacttagaaaaaaccgggatcatcaaattggacgttcaatatggcggagtcggccggccggtcaaccgctacgtgttaaaaggataaacctgagaccaaaaagaccaaaatgtccgttatgatcataaacttccccagactgtatgaaaacgctatcattctagtaagaaagacacaaaaggcgaataggacagggggatgaaggatatgaaactgtttaaaaatttaacagttcaggtcataaccgcggtcatcatcggggtcattgtcgggctggtctggccggatgtcggcaaagaaatgaaaccgcttggcgatacatttatcaacgctgttaaaatggtgatcgcaccaatcattttcttcacaatcgttctcgggattgcaaaaatgggcgatatgaagaaggttggaaaagtagggggaaaagcgtttatctatttcgagattgtcaccaccctcgcactcattatcggtttatttgtcgtcaatattatgaagccgggtgcaggtcttgattacagcaagcttgaaaagggagatgtatcacaatacacgcaaaatggcggtcagggaatcgactggattgaatttattacacacattgttccgtccaacatggttgatgccttcgcaaaaggggacattttgcaagtcttattcttttctattcttttcggagtgggtcttgcggcattaggtgaaaaagggaaaagcgtcattgatttcttcgacaaggtttctcacgtttttttcaaaattatcggctacattatgcgtgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttttgatcgtgcttggcacaagctcttccgaatcggtgcttccgcgtatgatggataaaatggagcgctacggctgttccaaatccgttgtcgggctagttattccgacgggctattcgtttaacctcgacggcacatccatttatttatcaatggcgactgtctttttggcacaggtgtttggagtagacctcagcatcggccagcaaattacgattatcctcgttctgatgctgacatcgaagggagcggcaggtgtgacgggaagcggatttatcgtccttgcctcaacgctgtcagcgctgcaggtcattccgctggaggggcttgcactcctgctcggggtcgaccgtttcatgagtgaaggaagagccattgtgaacctgatcggaaacggaatcgccacgatcattgttgccaaaagcgaaaatgaatttgatgaagcaaaaagcgtagaggctgttgaaggcatgaaaaaaatgaaaacagcagtctgaaaaaaaacggcccatccatggggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgatcaacttaatattgcttaccttcattttcacatttctaatggatcgtttggagcttgtcgtgcggcagtttgtaagccagttcttccgcgtgagccagcgggttgtcattacgtttctttacatgttgctggctgtgctgcttacagtcgggggctttgtgttttatccggtcgtcgcggcgcagatccagcagctggtaaagcagattaaacatattgcgtatcatcctgacagcatccctttctttgatgagatcaccagtgtcttcggagatattaacatcagttcatatgtcaaagagggcttcaatgtagtgtatacgtatctggccgatatcagcacattcggcttgcaggtcgtgatggcgctcattcttagcatgtttttcttatttgagaaaaaacggctttctgaattcatggcgaaatttaaaacgagcaaactgagggtcttttatgaggagattgcttttttcggaagcaaatttgcaagaacgttcggcaaggtgctcgaggctcaatttatcattgcgctcgtcaactgtattttgacgtttatcgcgctttggattatgcattttccgcagctgtttgggctttcgattatggtgttcttccttggattgatccctgtagcaggcgtcgtcatttccctgattccgctcagcattatcgcctacagcactggcggtggaatgtatgtgctctacattgtccttgtcatattcgccattcatgcgatcgaaacatatttcttaaatccgaagctgatgtcggcgaaaacagagctgccaatctttttcaccttcacagtacttattttctctgaacactttttcggcatttgggggttgattatcgggattccgatctttgtgtttctccttgatattctggatgtcaccaacaaggaagataggtctaaaggaccccgagagaatagcgataaagtttaaaatcgaataatgagtgtgcctcgatctgccggcctgcctgttcagggcatggaattaagactcggaatcggagcttggcattgcttcgcacagtggtgaacacaacaggtgacaatgcctgtcatcattacagaaactgaaaagaacaaacagtcggagtaaacgctcatcatcggtttaaccaaacatttggaagcaacaaatgctataatacaaacagtgcctaatgttgggcactgtttattttttgtcgaaaaaggaggaaggctttatggctgagccgattttacatattgaaggtctcgataaaaagattgggtctaaacagattttaaaacagatcagcatggacgtcatggagggtgaaatcatcggccttctcggtccaaatggttccggaaaaacaacactcatccgtattatcgtcgggctgctgaaacaaaacagcggaagcgtgacaatcagcggattccagcatgatacagagtttgaaaaagcgatggaagcggttggagcgattgttgagaaccctgagttctatccgtacctgacaggctgggaaaacctcaagcactttgcgaatatgcacaaaaaaatagcggatgaacggcttgatgaagtggtggaacgtgtcgggctgacgtcagcgattcatgataaggtgaaaacctattcccttgggatgcgccagcgtcttggaatcgcccaggcaattcttcaccggccgaagcttcttattctagatgaaccgacaaacggcctcgatcctgcggggatgaaggattttcgcgatcatattaaggagctcgcagaaatggaaggaacagctgtcctgttcgccactcatttattgcgcgaggttgaagacttgtgcgaccgtgtcatcatcattcaaaaaggtgagatcaaagcggaagtcagcttacaaggaactgatcaaaccacagaaaaagcgattatagaagtgcagccgcaagaaaaagcgctcaattggctgacaggcaatcaatatcaagctgagagccaagacgggacgattgtagttgaggtggcaaaagaaaacataccggagctgaaccgatcacttgtcggacaagggctgaatgtattttccattacgccttacacgcaatcactggaagacgaatttataaaagcgacgaccgctcatcaagaggagggagaagagcttgtctaaattaatttggaatgaacatatgaaactttttaatcggaaggtcactttggtttcccttatcctgatggctgtctttcaattcttcatggctttgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtcagcttctatttgtatctggcatactacattctggcattattattcggtcttgtgttttttggcacatcggtgactgcggaatcaaagacattgctggtaaacaccttggcgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcgtattgctgcttggattctcatttgtgtcattcatgtttcagtttgaacatcttgtttatttcaggctcgcgcttgggttgttttctctcgtgggactgtacatgatatataaaatgaagacgggcatccgctattttatcatctatctgtatgccagctggattgtgttggccgcagtgaccgcttttgaagagccgattttctcaagctttttctttggcggcctggtgatgacgatgggttacctgacatatatgctgatttatctcggcatgaaacaagaccgggatgcaaatcctgtgtaatcgcgctgttcccttggggaacggcgtgtttttctatactgggcaaaaggttaacagttgcggaaaaatggcaggaaatctataatacatattaaatttatcggaattaaaactggggggctgccggatgtcattatttatacaaaacgatcaacagcggcaatggatggagaaaatcggacggattgcggatgaatttcagcaaacagctgctgaagatgacgaacagggacgttttcctgcagagaaaatacaaaaactgcgtgatgctgggtatacagcattaacattgccggcatctcatggcggagggggcatttctgtttacgatatgctcttgtttcaagaacggcttgcacggggagatgctccgacggctcttagcatcggctggcatttgagcgtgatcggggagcttggagaaggcaacagctgggatgaagacgtatttgcatttgttgccaaggaagtccaaaacggagccgtcattaacagggcggcgactgaagcgaaaaccggaagcccgacaagaggagggcgtcccggtacacacgccgtcaaaaaggatggcaaatgggcagtgaacgggagaaaaacctttacgacgatgtcacaagctctggattattttttagtaaccgcatggattgaggacaaacaaacaacaggcgtgtttctcattcataaagatgatcccggcttgtcgattgaagagacgtgggatatgatggcgatgcgggcgactgggagccatgaccttgtactgaacgaagtaatgcttgatgagaataagctggtggaactgcttcaagggcctcgtggagctaagcccaatggctggctgcttcacattcctgcgatttatcttggtgtggctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggagcggcgtccacacttgaccagcgagctcggtgcggcgaaacatatcgtcacaaacgctgcgctgtctgttgttgataaagcgatgagaattgtcggggccaaaagcctggaacgaaccaacccgcttcagcgctattaccgtgatgtgcgcgccggtcttcacaacccgccgatggatgacgccgtgatacacaagctggcagctgaagcatttgagtcataaaaaaagagccttaccggctctttttatgtattgttttgctcttgcagatttttttgatgcttgcggtcaattctgtcataaataacgttcatcagctttggattgcccataatcgcctctttgttttcctggatcagctgttggtaagttttcactttacgcttcggcatgctccggcgccctcctgacatgtttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaacttcagtatacaatgtccgcaatagcctgtaaagatgaaaagagtcctattcttggccaatttacaaacattcaacaaatcgacaaaaagtttcccgggcaataatttgctgtcgaaatattccgcttcattgaacgcaccctgctatttttcatgttttgaaccatactatgtaatagaatggaggctggtattcaatggagcggacagaaaatctgaaaaagggagaaaaaggggcgctcctcaatatttttgcatatgtcatccttgctgttgtaaagctagttatcgggattctatatcattctgaagcgctgagagcagacgggttaaataatggaacagatattgttgcgtcagtagcggtgctgataggattgcggatttctcaaagaccggcagacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcagcgtccattaaaagctctgccctgatggcagcggcaaaggacagcaggtcagacgcttttgtaagtgccggcgcgtttatcggtgttttttcgtcccagctgaagctgccgtggattgatccggtaacggcttttatcatcggcatcatcatttgcaaaactgcgtgggatatctttaaagacgcttcacattccttaacagacggcttccatttaaaagatcttgagccttacaaacagaccgtcggcaggatcgaaaatgtgcatcgcctaaaggatgtgaaagcgaggtatttaggcagtacagttcatatcgagatggtcattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttgaaaataagcaggctgggaatgcccattacttggtatttttcagccaggtcaggaagctcgtccttattcagctcataccaatcgttttggttgtactcttccaaaatatcgccgatgaacatattcatgcgtgtgcagtctgggcaccaatcagcataaaactttacaatgatttctttatcggattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtggggggagtatccattgaaaacaagtctaggattagtgtacggaggaaagtcggcagaacataatgtttccctgcagacagctctggctgtaatcaaagcgctaaatactgagaagtttgatatacatccgatttatataacagaaaaaggcgaatgggttagaggcgcccgtttaactgaacctgtttcaaacgtgaaaatgcttcaatttgagcaaggaggcagtgctttttctccagctgccctgaaccaggagatgtttccgcaggaagcgtcacagcaaaatgaagccatcgacgtcgtattcccgctcctccacggaccgaacggagaagacggtacgatccagggaatgctcgagctgttgaacattccttatgtcggcaacggagtgcttgcttcctcagctggcatggataaagttgtcatgaaacatttatttgcgcaggccggccttgctcaggctaaatacgcagctttccttaagaaagactggactcgttctccgaaagaaagctgtgagcaggttgaacaggaattaggctacccttgcttcgtaaaaccggcgaacctcggctcaagtgtcggaatcagcaaatgccgaaaccgtgaagaactgcaaaaagcgtttgagcttgctttccaatatgatcgtaaagtcgtcgttgaagaaggaattaacggccgcgagattgagatcggcgttcttggaaatgatgatcctaaatgctctgttgtgggagaaatcgcaccgaagacagatttctacgattacaaagcgaaatatgaggatggagatactgatctgatgattccggcgattgtgactgatgaggaatacgcaacaatcagtgatatggcgatcaaagcgtttaaagcgatcgacggttcaggactcgtcagagcggactttttcctgacagctgacggcgaagttctaatcaatgaagtcaacacaatgcctggctttacacctttcagcatgttcccgctgctctggaaagaagccggagtggaatatgctgacctgattgaacagcttgtggagcttgcaaaagaacgccacgctgaaaaacagttgattaagcatacattctaatgaagaaggacactgccggtaaaagggcagtgttttttcccgtatatacaaaagaaagagagggacctaacttgattaagcgaacagtaaaaaacattgccgaaatggttgaaggcacactagcaaatccgcaatatgaacaaacagtcattcatggagtggcaaccgatacaagaaaactggaacaacatcagctctttattccgctgaaaggggaacgttttgacggccactcttttgtggagcaggcttttgaagctggtgtagcggctgttctttgggatcggtcagtaccaaatccgcccgagaatcacgccgtcattttagtggacgatacccttactgcacttcagcagcttgcaaaagcctatttgcaggagcttggcacgcgtgtcatcggagtaaccggaagcaatggcaaaacgacaacaaaagatatgattcacgccgtactggggacccagtaccgtgtccacaaaactggaggaaacttcaataatcatatcggtttgccgctgacagttttagcgatgcctgaaaatacggagatcgccgtattggagatgggaatgagcgccaaaggagaaattgacctcttgagccgcctggcaaacccggatgcggcagtgattacgaatatcggcgaatcgcatatgcaagacctcggctctagagagggcatcgcggaggcgaagcttgaaatcataaacgggcttaaagaagacggagtgctgatttatatcggggacgaaccgcttcttcaaaatgcatacagctgccagacgaaaacgtacggtacgggaacgcataatgattatcagcttcaggatgtcagccagagtgaggaaggaacccattttacaatcaaagggatagaaaaaacgttttttattccgatactcggcaagcacaatgtgatgaacgccatggctgcaattgctgcaggggcttattttggcatcgcgcctgaggatgcggcaaaaggactgagcggcctaaaggtaaccgggatgaggcttgaactcatcaaaacagacagcggcctttcgataatcaatgacgcttataatgcgagcccgacttccatgaaagctgcaattcaattgacagaaagcctcgaaggctacggcaaaaaaatgctcgtgctcggtgatatgcttgagctcggcgatcttgaagaaacgttccataaagagtgtggcgctgtgatcagccctgataaaattgaccgcgtctttacgtacggaaaactgggagcttttatcgcggaaggcgccctgaaacactttgagaaagaccgcgtcagccattacactgagaaaaaagatctcctccaagctgtgaaggaaaacgcatcaaaaggcgatttgattttattcaaagcgtccagaggtatgaagcttgaagaaatcgttaaagatttaatagagagcccgctttcataagaaaatattttgcgaaaaaacgcatattgcatcataaaataacatgatatgcaaacactaatgtatgccggccgaaaattatgtatatctggccggctgcggctatgatacaatatatataggttatttcgcgatacgaacatattcgtccggacttttcatcgtgacccgaagttctccgctggattcttgggagcggacggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggacgtcttcttgaccacatcaaccgccgcaccattcgtttaaacaatgtaaataccgttgtaatggatgaagcggatgaaatgctgaacatgggattcattgacgatattgaatctatcctttcaaacgtgccaagcgagcatcagacacttctgttctctgccacaatgcctgcgccgatcaaacgcattgcagagcgcttcatgactgagccggaacacgtaaaagtaaaagcgaaagaaatgacggtttctaacattcagcagttctatttggaagtgcaagaacgtaaaaaattcgatacactgactcgccttcttgatattcagtctcctgagcttgcgatcgtattcggacgtacaaaacgccgtgtcgatgagctggctgaagctctgaaccttcgcggatatgcagctgaaggtattcacggtgacttaacgcaggcgaaacgtatggttgcgcttcgtaaatttaaagaaggcgcaatcgaagttctagtcgcaactgatgttgccgctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggtcagcaacaggttactgttgaacgtcttcgcacaacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggcttttttatgttcgtgatttgttattcagcaaactttcagctgacggaagccatttttctctgtatgcttaagaatgaaacctttctgtaaaagagacgtataaataacgacgaaaaaaagggaggtaggtatttttgagagagcagccaaaaaaccaaatcagtccagacggattaaaggtttggcgacttcaagagatcatcatatccgctgtttgcttgcttattgtcattgcagttgcagtgttaagctattattttcattggccgtactggatcagcggcgtgctcggcgctgtttggctgctgggatcgattgtgacggtctttatcattccgaaggtccgtcataaggtgtggcgatatgaagtccatgaacatgaaatagatattcagtcaggtatttttgtggtgacacgtgtgattgttccgatggtcagagttcagcacgtcgatacgtcacaagggccattattaaaaaaatacaacctggcaacggtgaaaatttccacagccgcgaccgttcattcgatccccgctttagagatggaggaagcggatcggctaagagactccatttcccgtctggcgagggtgactgacgatgatgtctgaaccgaaacgcctgcacccggtggcagtcattttgaatttatgccataccattattcaaacgataaaaaatatcattctgccattcttttttgtgtatattgtcaattcaaaccatactgtccgtttttacggagccattgcgctcggtgtgctgttcatctggcttgtagcggcaagcattatcaaatggagaaggtttacctatcgaattgaagatgatgaatttagaattgaagaaggcttatttgttacgaaaaaacgatacatatcgattgatcggattcaaacaatgaatacgagcgcgggccttgtccagcaaatctttaagcttgtgaagctgcaaattgaaacagcaggcggaggcaaggaggcagaagccgttctttctgctatttctgttgaagaagcggaacgcatcaaagaagctgtctttaagaaaaaagcgcaaagacgagaaaatgaacttgatgaagaacggcttgaagctgaagaggagttggatccgtccgttgaggtgcaagagcactatcgcatgaacgcgaaagaattgctcatggccgcttctacctccggcggaatcggagtcattatctccgctgtatttgcacttatttcccagcttgatgaagtgctgccgatggattggttattcgataaattttccttccttcagcacgccagcatcggtatttatgcggtactcatttttatcggtttatttatcgcctggattttcagcatcgcgggcatgatgtttagatacgcgaactttcaaatcataaaaaaagagcaggaactggtgatttcaaggggaattattgaaaaacatcaagtcacgattccgctgcgaaaaatacaagccattaaaatcaaagaaaatatcattcgccagcttttcggctttgtaacggtgtccatcgtcagcgcaggaggcggcgaccgggaaaaagaagaaggcgctttgaccattctctttccaatgattcataaaaaaaagcttccgcacatgctccgaacatttacgccggaatacacgctggaagaaaactgccgccgcctgccgcggcgcgcgttgaaacgctatttgttccgttctgtcattttttcactctttttgatcatcccgttatgtatcttctttcagccatggggctatctgtcagtgatcctgctgccgatagaattgctcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaagtggtactcatatgaaaaagcggacggttaataccgccgctccagcgtgtcggcaaaccctcgcattcgttgtcaggactgcgcttcggtgctcacgaattagaacattcgctccgctcctatgctcgtccttcctagacttcaagggttttcaatcacgctgaaaagatgacaaaatcctaaaatgaaaaccattttaggattttgtcaacaatctgaagcggcggttaataccgccgctcttttttttgcacgcataaaaacgaaagaagaaacccgccgcatagtccaaacaaatgggccatcatgttaatattggagttgataaacgacatgagaacggcaaatgcgagcagtgtgatgatcattttggaatgctcctgcccaattaactcattgcgaaaaagaaccataaacaggtatacgccaaatagcccgaaaatggcgcctgaagccccgacatgcacgtaatcaagcggctctgtaacataagtgccgatattgccgatgatgccggagccggcgtatacaagaaggaaacgcgcttttcccagcatgcgttccaaagccggggcaaataaaaagatggacatggaattaaacagcagatgtgtgaaaccggcgtgcagcaaaatcggtgtgataagccgccaccattcaccgtttgcgacacctagattatagcctgtgacggtatccctccataacacgactgaatgggcaggaagtgaaaaaaacagccagagaacagcttgcaaagccaatataaaggtgacaacggggtaaagcctgataaatgtttgaaaattttcagtccgtataaacattccgagccccttttcttcattttggtatatctatagtaacacgtttatgagacaaaccatttaaatagtacgtacgcaaaggaggttatcatacatgatttacggcattgggctggacattaccgagcttaaacggatcgcctctatggctgggcgccagaaaaggtttgccgagcggattttgacgcgaagcgagcttgaccaatactatgagctttcagagaaaagaaaaaacgaatttctcgcgggcagattcgcggcaaaagaagcgttctcgaaagcatttggcaccggcattgggaggcagctcagctttcaggacattgaaattaggaaagaccaaaatggcaagccctatatcatttgtacgaaactgagccaggccgccgttcacgtatcgatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaaggggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagaaaatccgaaaaaggaccaaaaccaagtcattttacgaaatgaaaacggagtattcgttctcacgccgtctttaaataagagcttcagatttcaaagcgattggccgaacaacagcagccaggtttatctgtttgaatcgctcgtaaaggatgttcaaaacgattcggatgcagttttcacagcgaaagaaaagaaatacgtatttgaaacaaaaacaaactatcagcataacaaaatgctgcccacgcaagaaatcacatttaacaaaaaagatatgagcccgtcatctgtcaaagtgatggatactgaccggaaagtgatggtcaaagtagaattcagcagctttgaatttaataaacaatttgataaagaatcatttgatgaaaagaaaaatatgaccctttctcaaatggatgtcgccacaagcgcaaagccttccgatacatttgcggtcaaaacgccgctggaactgccgcttggcgtcaagctgcttgaagaaaaagatatatctactgaagacgggaagcgcatcatcatgacgtacggaggagaaaaatcatttacgttaattcaggaaaaagcccagattgccaaggcttcctcctccgttacgctgaacggcgaaccggtaaatctcggctacaccatcggcgccctgtcggatgcatcattatcatggacatatgacggcgtagattaccttctctcttctaaagatctttctaaagaggaaatggtgacagtagcgaaaagcatgcagggacaatcatcgaaataaccgccaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacttgatggcagttgtgaaagcaaacgcctacgggcatggtgatgcagaaacagcaaaggctgctcttgacgcaggtgcttcatgcttggccgtggccattttggatgaagcgatttcactgcgcaaaaagggattgaaggcgcctatattggtgcttggcgcggttcccccggagtatgtggcaatcgctgctgagtatgacgtgaccttaacaggttattctgttgaatggcttcaggaggcagcccgccacacgaaaaaaggttctcttcattttcatctgaaggtcgatacggggatgaacagacttggtgtaaaaacagaggaagaagttcagaacgtgatggcaattcttgaccgcaaccctcgtttaaagtgcaaaggggtatttacccattttgcgacagcggatgaaaaagaaagaggctatttcttaatgcagtttgagcgctttaaagagctgattgctccgctgccgttaaagaatctaatggtccactgcgcgaacagcgccgctggactccggctgaaaaaaggcttttttaatgcagtcagattcggcatcggcatgtatggccttcgcccgtctgctgacatgtcggacgagataccgtttcagctgcgtccggcatttaccctgcattcgacactgtcacatgtcaaactgatcagaaaaggcgagagcgtcagctacggagccgagtacacagcggaaaaagacacatggatcgggacggtgcctgtaggctatgcggacggctggctccgaaaattgaaagggaccgacatccttgtgaagggaaaacgcctgaaaattgccggccgaatttgcatggaccaatttatggtggagctggatcaggaatatccgccgggcacaaaagtcacattaataggccggcagggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatataagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaatatgttgttttttattgggaggtaagcgaatttgatgtcgaaccagactgtataccagttcattgccgaaaatcaaaatgaactgctccaactgtggactgacacactaaaagaattaagcgagcaagaatcctatcagctgactgaccaagtgtatgaaaatatatctaaagaatatatcgacattctgctgctgtctgttaaggacgaaaatgctgctgaaagccaaatcagcgaactggcgcttcgagcggtccaaatcggactgtctatgaagtttttggctactgcgcttgctgaattctggaagcgtctctacacgaaaatgaatgataagagattgccagatcaagagagcacggaattaatctggcagattgaccgctttttcagcccgattaacacagaaatttttaatcaatactcaatctcatgggaaaaaacagtatccctgcaaaaaatcgcgctgcaagagctgtctgcgccgcttatcccggtgtttgaaaatatcactgtgatgcctcttgtcggaacaattgataccgaacgcgcgaaacgaattatggaaaaccttcttaatggcgtcgtcaaacaccgttcccaagtcgtgctgattgacattacaggtgtccctgtcgtcgatacgatggttgcccatcatattattcaggcatcagaagctgtaaggcttgtcggagcaaaatgcctgctggccggaatccgtccggaaattgctcaaacaatcgtcaacctagggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtgtccattcagtgggaacttgatgaccaatcagcattaacctttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcctgctgtggcagtgacgctgattgaacttggaatcgcacttgaggaaatcgaaactgcgctcgacttagagcaggggcttgagacattgaagcgggaattgggggaatagcgaatgaacgaccaatcctgtgtaagaatcatgacagaatgggatattgtggccgccagacagctgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaatcatagcggaagaccaagggccgggaattcctgatatccgaaaagtcatggaagacgggttttcaacgtctggaggacttggtgcgggacttcccggggtcaaaaggctgatggatgaattcagcttaaattccgtagcgggggaaggaacagagatacaagccatcaaatggcttcggtaggaggtaagaacgtggattttagggaggttattgagcagcggtatcatcagctgcttagtcgatatatagccgaattaacagaaacatctttatatcaagcccaaaaattcagccgaaaaacaatcgagcaccaaattcctccggaagaaatcatcagcattcacagaaaagtgctgaaggagctgtatccaagtctcccggaagatgtgtttcattcgctggattttttaatagaagtcatgattggctatggaatggcttatcaggagcatcaaacccttagagggatacagcaggaaatcaaatcagaaattgaaatcgcggcaaatgtccaacagacgcttctcggaactaaagttcctcaggaggaagcgctggatatcggcgccatcagtgttcccgctaaacagatgagcggtgattactaccactttgtcaaagacaaggaatccatcaatatcgcaatcgcggacgtgatcggaaaaggcattccagcggctttatgcatgtccatgattaaatacgcaatggactctttgccggaaacgggcatacacccttctcaagtgctgaaaaatttgaatcgtgttgttgaacaaaacgttgatgccagtatgtttattacgatgttttatgcgaattacaatatggacaagcatcaatttacatatgcttcagcgggacatgaaccgggattctattattctcaaaaagacaacacgttttacgatttagaggccaaaggactcgttctcggcatctcgcaggactatgactacaaacaattcgatcagcatctggaaaagggcgatatgattgttttattttctgacggcgtcacagaatgcagaacggaaaacggtttcttggagcgtcctgatctgcagaagctcattgaggaacatatgtgttcctctgcgcaggaaatggtcaaaaacatttatgacagcctcctcaaattgcaggattttcagcttcacgatgattttacgttaattgttttgcggagaaaggtttaacgtctgtcagacgagggtataaagcaactagtgatttgaaggaaaatttgaggtgatacgaatgaatataaatgttgatgtgaagcaaaacgagaatgatatacaagtaaacattgcaggagaaattgatgtatactcagccccggtgcttagagagaagctcgttcctctggcagaacaaggagctgacttaagaatttgcctgaaagatgtcagctacatggacagtaccggattgggcgtttttgtagggacctttaaaatggtgaaaaaacaaggtggttcgctgaaacttgaaaatctttctgaacggctgatccgactgtttgacattacaggcttgaaggacatcattgatatttctgcaaagtcagaaggtggagtgcaatgaagaataatgctgattacatcgaaatgaaagtgccggcccaacctgaatatgtgggaattataagactgacgctgtcaggggtcgcaagcagaatgggctatacgtacgatgaaattgaagacttgaaaatcgcagtcagtgaggcgtgcacaaatgcggttcagcacgcttacaaagaagataaaaatggggaagtgtcaatacgattcggtgtgtttgaagaccgtttagaggttattgtggcggatgaaggagacagctttgactttgatcaaaagcagcaggatctagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaagcaagatgaacaggcgcaggaaacgcttgtgcgggtgtatacaaatctggttgacatgcttgcgaaaaaatattcaaaaggcaaaagcttccacgaggatctccgccaggtcggcatgatcgggctgctaggcgcgattaagcgatacgatcctgttgtcggcaaatcgtttgaagcttttgcaattccgacaatcatcggtgaaattaaacgtttcctcagagataaaacatggagcgttcatgtgccgagacgaattaaagaactgggtccaagaatcaaaatggcggttgatcagctgaccactgaaacacaaagatcgccgaaagtagaagagattgccgaattcctcgatgtttctgaagaagaggttcttgaaacgatggaaatgggcaaaagctatcaagccttatccgttgaccacagcattgaagcggattcggacggaagcactgtcacgattcttgatatcgtcggatcacaggaggacggatatgagcgggtcaaccagcaattgatgctgcaaagcgtgcttcatgtcctttcagaccgtgagaaacaaatcatagaccttacgtatattcaaaacaaaagccaaaaagaaactggggacattctcggtatatctcaaatgcacgtctcgcgcttgcaacgcaaagctgtgaagaagctcagagaggccttgattgaagatccctcgatggagttaatgtaatgatccaggttgaagaaaacgagcatattcaaactctagtatatcaactgaataaagaagggaaatcgatttgcggtgacagtttttttatgaaagctgatgataaggagttaatttgcgcggttgctgacggactgggaagtggatcacttgctaatgaatcctctgcagccatcaaagacttagtggaaaactatgcgagtgaagacgtagaaagcattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccatttaaaaaaaggccaatcggtagaagaaatatcgaattcgctgaaaatgtatacgacatcgagaaaagatgacctgacctatattctcggacagctgtcctaaaaaaccagaaaaagaagctggacatccggcttctttttttttgcggttgactattaataagtgcgcttattataattaataagtgaacttatcattctgggagcttatggatgtggaattatgaatacacagcgatagctgatgcggatgtgggaaaacctggaactgttatcaggaaacagaaacaatggatcaatgggagacgggtattgcatcagattctttgaaaggacaatttcaaaatggaacggaaggaacattgcttctgcaaggaaaaacaattctcttatggcttgagcatgtggagaaacatcggtcattttctgtcatggccaacatgccgcataacaatgtaaaaatggagttttctcacgtgcttcaaaagcaaaaagaagatttgcgtatcacatatggaattgtattagaaggcgctgaagcaaaaaagtggggagaaatcattgggactgaactgtctaaagacatgccgacggctgtcagcaggcttgtccatctttacggaggagtgataaaatgaacacaaattactggatcggcgttgtgtcagagcagcatgtattaaaaggcgctgccggcggttttgcacagctgtgccatggaaaaaaagccccgctcgccaaaatgaaagagggagattggctgatttattattctccgagagacgcatatccagacggcaaactgctgcgaagctttactgcgatcggcaaagtaaaaagcggaaacatctatccgtatcaaatggctccgaattttattccataccgattagatatagactattatccatgccataaaatcggtttttacgacattaaatcaaagcttgaatttgttcaggaaaccaagcatcttggctttttatttcgcagaggacactttgaaataagcaaaaaagattttttgacaatagcacaagcgatgggagttaacataagtggaatggcactctaaatttagcggtccgaacacaagcccgggctttttattatggcaggccacgcaaagctggcagcggaaagtgggaaaagcattggctgagtttgacctgacccacgttcaatttgttctgctgacctcgtgcaagtatatgattgctcacggagaaaccgtcacgcaaaaaaaacttgcaagcttcagccagaccaatatcatgatggtttcggaggttgtgcggacgcttgagaaaaaaggatttatcgaaagaagcaaaaatccccaagataaaagagaggttctcctgtctcttacagaaacaggaggagaaaaagtaacagcgactttgccaattgttgagaagattgatcaagccttctttgcagctgcgatgaaaaaagagaattttctgagcggattacaggaactattgaaacatgagtaaagagacgggcagcgtcagctgtctttttttatgtgtttttttcggtttttgatacactagagacagaacgacaaaattggaggctttggttacatggaaacgtcagcccttttaaaacagcaaattgcgaaagaaataagtttatcacaaaaacacgttgaaagtgtcatccgcctgcttgaggacggcaatacagtcccgtttattgcccggtatcgaaaagagcagacgggttcaatggatgaggttcagattcagacgatttctgaacgctggcaatacatacaaaacctgaatcagcgaaaagaagaagtcatcaggctgattgcagagcaggataaactgacagatgatctaaaacgtaaaatcgagcaatcggtgaagcttcaggaagtggaagacctttaccgcccttataaacaaaaacgcaaaacaaaggcgacagtcgccaaaagcaaaggccttgagccgcttgccgactatatcctgacacttccccaagatgatcgtctggcagcaacagcagaccaatacatcagcgaagaaaaagaagtgttcacacgagaagaagcgattgaaggcgccaagcacattattgcggaacaaatttcagacgagccgaccttcagaaagtggattcgccaggaaaccttcaaaagaggaaccattaagtccgcagccggaaagtcggcagacaccgatgagaaaaatgtgtatgaaatgtattacgagtatgaagagccaattgcaaaagtcgttccgcatagggtactggcaatgaaccgcggcgaaaaagaagatattttaaaggtgtcaatcgaaccgcctgcggatcacattaaggcgtatttagaaaaacaaatcattaaaaatcgctcaacatccgtaaaagagattttgcaggagacaattgaagacagctataaaaggctgatccagccggcaatcgagcgtgaaatcaggaaagagctctcagaaaaagctgatgaacaggcgattcatattttctcagagaacttgagaaaacttcttttgcagccgccgatgaaaggcaaaaccgttctcggtgttgacccagcctttcgaaccggctgtaagctcgctgtgtcagatgagactggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagaacaattcatcgtcaatgtactgaaagacatgccgcgcaaaatttattatgtgatcgtcaatgaagcgggtgcaagtgtctattcggcttcagagctggcccgagaagaattccctgaccttaaggttgaagagcgcagtgccgtgtctattgcgcgaagacttcaagacccgcttgcggagctcgttaaaatcgatccgaagtctgttggtgtcggacagtatcagcatgacgtcagccaaaaacgcttaaatgaatctctgcggtttgtcgtcgaaacggtcgtaaaccaggtgggagtaaacgtcaacacagcctccgccgcgctgcttcagtatgtagcgggattatcgaagtctgtagcaggcaacgttgtcaaaaaacgtgaggaaatcggaaagttttcaaatcgaaaagaactgaaggacatcccaaggttaggtgcgaaaacctacgagcaatgtatcggtttcttaagagtgcaggaagggacagagcctttggatagaacaggcatccacccggaaagctataaagaaacaaaagcacttttgaaaaaactcggactttcaacagaacatatcggcacggcggaattgaaggacaaaatcaatcagctggcgctctctgaaacggcaaaagagctgggaatcggcgaaatcactctgaaagacatttgtgaacagctgacaagaccggaacgcgatccgcgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaactgagcaatcaattcgtcaagcatcctcttgatgtcgtatctgtgggcgatatcgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcactatggataatatagagcttcaaaagctgacagaggatatttctaaaacatattttaaaaagccgttccgccatcaggcgctttttaatgacaggcttaaaaccacgggcggaaggtacctgttaacctctcataacattgaattgaacagaaaatatctgattgaacacggcagggaggagctgatcggcatcatcaagcacgagctctgccattatcatctccaccttgaaggaaaagggtacaagcacagagacagagattttagaatgctattgcagcaggtcaacgcgccgaggttctgtacaccccttaagaaaaaagaggaaaacaaaaaaacttatatgtatatctgtacggcctgcggccaacagtatataaagaagcgcgccatgaaccctgacagatacagatgcggaaaatgccgcggaaaaataaaaagaattttttcgtgaaaaaggttgacgaatatggcaagcctatgttacattataaaagtcgtcacgagagataaataaaaacatttacctcttgacactgcaaattaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccatttttatttttgaaatctaatagtaagagccattagctcagttggtagagcatctgacttttaatcagagggtcgaaggttcgagtccttcatggctcaccatttgtatttttgcgggtgtggcggaattggcagacgcgctagacttaggatctagtgtcttacgacgtgggggttcgagtcccttcacccgcactttatttacaaagtgcacgcaaatcggttttactaggttaagagcctactaaaccagcacaaacacaatttaatgatcacgcggtcgtggcggaatggcagacgcgctaggttgagggcctagtgggtgaataacccgtggaggttcaagtcctctcggccgcatcaatgataccaagggttttgacgcccttggtatttttttgtgtttattttcaaatgatttactgcccacaaactgcccacttacctaaagtaagtcatctaatttatcagccatttccttttgcttgtttggatataggtgtccataaacatcaattgttgtttttacagaaccatgtcctaaacgctctttaattgttatgtaatcttctccttggtgtattaatagtgcaacgtgtgaatgtctaaaatcatgtaaacgtataggagtaagatcgctatccttgcaaaagtatttaatcttccgactgaaaatatcttttcttgaaggtgtatctttatattgaaagatataggtgtcatgtgaatgtctaatacctaattcattaaacaactcttcttgtgcttctttccagctttctagtagcttaagcaattttttattgatgctaactcgccgaatcgaatttttggtttttggagtagtaacaacaaattgaccatcaagccaggtgcacgatttatgcacatctatttctaataagattttgtcaatatctttccattgcagggcgagcatttcaccacatcttagtccagttaaaaaagcaacagtataaaatgttttaaacaataattgatcttgaggaattaaactcataaattttttgaattcttctggtctccaaaacttcattttctttcttgttaaaggtaatcgtttaacgttgtcacacggatttctttttaagatttcttcatgtacagctgtatcaaaaattttgcttagactagtcattatattattaaccgatttattgcttagacctgtttccattaaatgttttctgaaatcagttatttctctatgtgtgattttttgtatatcagatttcaaaaagtaatcagatatatgtttgtttataatgtatttctgattctgataatagtttggtttactatctatttcacaatttgctaaataaattgaaattagagtcggaaagcttactgatctggactttcttgctctttcttcttgaaattctcttcttaattttgcttctaattctaaagcctcttttctggttgatgctactggtctcgtcctaattctttctccagtaatcgggtcaaatccaaaactaacgtcaacttgatattgaccattttcaagtttttttacagacattttatttctcctttaaccaaaagcgcttatttcgtgtgaatagattctgttactaaatgagccaatttgagaaagtttataatcagtaacaaatgatggtacgttgaagtatgctgctatttgttctttgctaaaaccctgtatatatggaagggcttcattaagcattttatctgtcagtattaattctgatgcaaataggcttgcttgatgctcaagtttctcttttagaactttagagcaattcacaactttaaaagtgtttaatcttttatggagaaagtaatgccctaattcatgggcaattacaaattgttgatgttggaggttctcgttgatatgaattaaatattgatctgtggctttgtcatgttgtagtaaaccgtttgcttgtccaagatcatttttgagtatataaattttttggatgtcgcaaatttcatagacattatttgtaccatgtgtcttaattactgattggactttatgtttaattcctttgcttgtataaattgttatcactctttcttctttaattcgtcaatgaatttaattccgttttttaatgcttttttgacaaggcgtgcagtttcctcatcaaattcaccatcattcataaaaaggagtgtatcttcatcctttaattcctgtatggcttcattaattgttttattgagtaaatcagtttcgtttttcttgcttacttcatcttttcctaataaatagtctgtagatacgttatataagttgctcaattttaagagtgtgtctgtatcaggatctctgtaatctctttcgtaattagacaagttattgttaccgatgttaagtttctctgcggcttctttctgagtgtatccagctttttgtcgagcttcttttaatcgtttgcctaggctcatttttatcatccatttcacaaagagttgatttttataaaaataataacaacattttttggagaattcattaatttcacctataagttaaataaatgattcaaaattctccttttaggagtgtttacttcttctttatggagagtttaattatcaatatttccatatatgttcaaaaaaatacactttaaggtgaattttgtgttgacttacacgaaaaggagttttataataaagttaattcacaaagagttgagttaacgaggaggtgatattttgaaaggagagtttttaactgcgagagatattcaaaaaattcttggagttaaacaggctaaatcttatgacatcattagaactttgaatgctcaaatgaaagaagaaggatatatggtcattcaaggtaaggtgagtagagctaagtttgaagagtgttattgttacaaaggtccaaaatctcaaacggggtgatttttataaacattgatataacaaactcgtttatgaaagaagctgttcctttagccagacaaatggaaggtgattggatagcacgaatgaaaattgctctgaattcagtcatcataaatcattatttaaaccttcccttaacaattgaaaatgttaatgaattactgcgaaaaggtgtttcatatcgcaggatatgtaagcattatggcattggaagaaaagacattgaaaagctgcggcaatcatccatagtgtgacgttatataccactatagggagccgttaagaatcctttgaaagggggggggcgatgaaaataagagtaaatgcaacaatcattactgatgttgaagctttaaaggctgataaggatttgaatcattttaaagactatgccacttgtgaaacattcgttgttgatgctgataattatttgaaggctaatgaagaaatatctgagttgttaaaaggttgggattggtggtgtatctggtcaactcgtccattgagtaaaaaggataaccaagtgtttactttgtataacgatgatttatataacttatgtcgctaggagtgtttgttccttgaaaactacgtatagacaaaaaaagcgccttgacgaatgatcatcaagaacgccgtgtaaagattagacacctttattatacggcacttttataaaaaagtcatgcgtgagtatttgagtgatgaacagcaatcactttaaatgctgtagcaggctagaataagcgtgcggaatagctgtagtcagcttgatggctataattagcctactaggttgccatgagggcataaagccgttagcaactgataagcgccaagatggatacagaaccggagcgaatcaaaaacataaaatcgaaattaatgttcttttgtaaataaattataaaaaaatgaaatggggatatgaaaaatgaacttaaactttattgtaccggatatcaatatgacttttggagacatgaaattcatgggacttaacagagaaaggtatgtttatgatcgtgaaaataataagcgtactgacgtactggaatctaggatttataacattgctagtgctgttcaaggtggtcaaattgaagtaactattcctgagtatgctggggcaaaagaaattcctccttttgcagatattgagttgaaaaacccaaaaattagcgctatggcgactagtcaaagggattcgacgtatgccaatgtgatgtggaaacttgaagctgatgatattgttgttaaaggtggctcttctgtgaaacctgccgcggcaactggcgggaatgaaaagaaataacatgatgctctcatatcggcaggcgggtgatgtatatgagtgatttcttaaacaaaagattttggaaatacaggggcaaacgaatccgcccgtacatgagaaacaacgtaaaattagcaggcgcaatcatctttgtgcctgtttttttattgtctatgttccttttttggagagaacaactcattcattttgatctatctcaagtgataaaaaattttgaatggaatgtgcctttaatcattaaaagcgttttatgctctgtgctaattgctgttgggagcatagttgcatcttactttcttttgtttgacagctataagaaaatccttcacaagcaaaagattgctaaaatgattttctctaacaagttttacgaaaaagaaaatgtgaaagtaagaaaaatcttttcaaatgaaactgactcaaaggaaaagatcacatactttcctagaatgtattaccaggtcaaaaacaaccacatctatattcgtattgctatggacatgagccgttttcagaatcgcttcctagacttaggaaaggatttggaaaacggcttattttgtgacttggttgataaacaaatggaagaaggttttgtatgctttaagcttctttacgatgtcaaaaagaatcgtatttccattgatgatgcagtggctgagaatggaatccttccgttaatgaagcatatctcatggcaatttgataagttgccgcacatgcttattgcgggtggtacaggtggagggaaaacatacttcatgctaacgatcattaaggcatgtgttggactgggggcagatgtaagaatactagaccctaaaaatgcagatttagcagacttggaagaagtacttccgaaaaaggtctattcccaaaagaacggtattcttatgtgcctgagaaagtctgtagatggcatgatggaacgaatggatgaaatgaagcaaatgtctaactataagacaggtgaaaactatgcctatttaggcttaaaacctgtttttatcttctttgatgaatatgtggcgtttatggatttgttagatatgaaagaaagaaacgaagccctttcttacatgaaacagttggtcatgttggggagacaggcgggttactttctcgttttaggggcacaacgtccagatgcaaaatatttggctgacggtattcgagatcagtttagcttccgtgtgtcgttaggtttaatgtcagatacgggctacgggatgatgtttggtgatgttgataaagcatatgtgaataaaaaagagacagggcgaggatatgccaatgttggcactggttcagtgttggaattttacagccctatcgtgccgaaaggatatgattttatgtcgtctattaaaaatgcgctggttggagtcgagggagcgcaggcgacggcagtcgccagcggcagcgtaagcgaccagacggccagcggcgaaggagtgagcgaagcgaatggatgagctaaaacaacccccccacgctaacaggggggtagtaatcgtaaaagaagagaatgaaaccgttgaaagtcctttagtatcaatggttgactatattcgagtctcttttaaaactcctgatgttgacagaattattgaagaggttcttcatcttagcaaagactttatgactgagaaacaatctggtttctatggctacgttggcacgtatgaactggactatgtcaaagtcttttattctgcgccggatgacaacagaggtgttttgatagaaatgtccggtcaaggttgccgtcaatttgaatccttcttggaatgccggaagaaaacatggtacgacttctttcaagattgcatgcaacaaggcggttcgttcactcgctttgatttagctattgatgataaaaagacatacttttctataccggaactgttaaagaaagcccaaaagggcgaatgcatttcacggtttagaaaatcggatttcaatggctcctttgatctatctgatggcattacaggcgggacgacaatatatttcggttctaaaaagtcagaagcgtacctttgcttttatgagaaaaactatgaacaagcagaaaagtataacattccgttagaagaactaggcgattggaatcgttatgaattgcggcttaaaaatgaacgtgcacaagtggctatagatgctttattgaaaacaaaggatttaaccttaatcgctatgcagatcattaataactatgtaaggttcgttgatgctgatgaaaacatcactagagagcattggaaaacgagccttttttggtctgaatttataggtgatgttggaaaacttcctttgtacgtcaaaccacaaaaagacttctatcaaaaatcaagaaactggcttcgtaactcttgcgctcccactatgaaaatggtgctggaagctgatcagcacttagggaaaactgatctgtcagatatgatcgcagaagctgaactggcggaaaaacatgaaaaaatgttgaatgtgtttatagctgatgttgctgacatggtggtttaaaaacaagctgctaaatctttataaacacaggtgatgcgattaaacgtatgtgtcaacggtaccggaacgaagtgaggataaggagttgacatattcagcgccaccaaaaccctcttggcaatgaacaaacaaccgtttgttcctgcctaccggcgagggagtcccccgatgattcgggggaatagggggctagattaacagcaatccaaccaaacgcgccagtttgaggaatagtaccttataataaaaactgctgagtgctacctagactgaatactccacccatgtgttttaagcttttttatataatcttcaacactaattttttcaacttcaattgctaacggcgtcagtgaaacaaggcactcatttgaagtataatttattgtaacttttaccacctcgtatccattatggaagcctgaatcaaatccaggatcgtcaattatatctcctacttgagggcgaaagtcagattcaaatgttttcactaatgtttgagtattttcctctgtaggttcttgattaattgatgagacaaataatattaaatttattttcaaaacatttacccccatgctgttaaataatctttagtttaattctattgttattgatgattgagtgcaatgcttccgttggtgggtttgggtgaaacccaagaacttaattcaatataaggatggtggatatgttatttacgatattttttgtaatcgtgagtttacttggcggcggtctcttattccttttgatatatcctaagcttcaaagtttggctgaccgttattgaggctagacgaaaaattaaaaaaggagagattgttagtgaaaattaatcggattctattggcagtggttgtattagctggtgttttcacttttacccacttacaaaatgaaagtcctactggtgaaaaaataaggattgcgtcagatagagttgcagcttaaaaaaagtttttatgcttataataaggttagaagccatacttctaaccttatttgtattgcattttaaattaatttaatggatgtcctttaaatatggatgatttcaatgtgtcttctaataaacatgtcaaattattttgcatttttggcatgttctttgccttgctgttttattgtaaagacaggattaaatatatagttgtgaaatttgttataataaggtaaacggtaagtggacggagggacaatttgtctgattattatgaattgaaaggtgtacaagcaatccaaactgaaactttaaaattaggatcgaagttagtttctaaaataaatgctggtgataaagaaatatcttttgatggagaaatacagttatataactcagcagcgcatactaaaggaacatttgaggaaattgtaaaagttcaagttaagggaaccggggtagaagagttctctgaaagaaaaactacattctcattagaattagaacactataaaaattacttgaattgtggtggggttttgttttttgttgttcaagtaagaaaaagagatgaaaaaacaaaaatattttttaagcaactgttgccattagaattacacaaaatcattaagctatatgagaatcagaaaactagaatcatggagttaaaagcacttgatggcactaatttggagagtgtatgtaaatcttatctttcagagcaaaaaagacaacctagtatgtttattgggaaagaatataaacctgatgaattctcttactataaacttagaagtttaacctatgattcatcaagtaaattgttagatgaagaattctatttatatggtgtagatgaatatgaaaaaatgtttccggtagatatgcttactttaaaaggttatactattgctaaaaaaagagattttaaaattggtgaaaaaaattatgttttgtttagtgaatttcactatgaaaattctcaacaaactctaataatagaaaaagttcttactatgaggttcgaacagaataaactgacttatgaaataaaaaaatttggtacgttagaaacccaattgaaaatagttgcatttcttttagacgtttttgcgtatatggaaatagagtgtgaagaatttaagtttaagctgaaaaaagcctctaaagtaagtaaaacaagggatatcctagaaggaacttattttaaactgaataagttaaaacacatttttagtgactttaaaattccattggaaacgaatattggcgactttaaagataatattacaaatcagatgatgcttcttataaagactttttatgataatgaatatggaaatttaaaatttccagatgccattacatttatggatatgtttttgggggagttgagaatcgctttactacatgacccaactaatgaaataaaaattaaaaatgctttttcaaaagaagtagctgaaatgagaatcgttgctggtactgaagaaatagaagaggctgaacatatagaaagtcatactccagttagtatttattctttaatgaattcaaatttaatgtataatgcggctaattttgatatagaagtggttaaacaatcgttcgatagggttgatccttttataaataatacttcattccaaataaccaacactttctgtttagagtgtattaaagccttcgataggagtggaaggttcgacttcttatctgttgcagagtatatttatcaaaaacattattatgtttctgatgaggattttgattcaatagtgatatttataaacaagtgtcaaatcgaatacaggtttaataaaaaattatctgagcaaagtattgaaaaacttatgaatataaaaagaatttataatgattatggggttttattttctgttaacatattattaggttcgataatagaagccaactatttttaaataagatgccgaaaaaagaaagagatagttttcttacctatcccatttataaaatgtataaagaattattggaaaaaaaacaaaaaaaataagggggaaattaaaattcttaatcaatggaggaaaaggttagaacggagtttattgtttttactcaccattttttaaccataattgatgtaaacgtatagaaatgatagcaaatgaataaaaggagtgtaatgaaaacaagctttcataaccaatgatatggatttactttgttgagggtctagcttagaaaaccataccaaaacatctcggtatggttttttatattataattattcaatccccaaaacaactttatttggaatgggaagattaatcttcccattcctcatcttcgtcaaaatcctctttaccttttttaagttgctgaagaagaaattcaagaaaactatttgcagcagtataaccatatccttcatggttgtcccaaaggataacaggacattctccatctaccattttatttgtatcaagacaataagagaattcatctatatactcaataacaacaagacctggtataagattgtagaacgttctgtattctttggtttgctctacaatttcagctccatgagagtcataaccgagtatcatagtcccgaacgcgcctcctgaaccatactcagttaaaaaccacttataactgtctggtagggttactttgagatctttttctatctctttaatatgtttgtcagtgacgcctccagtaagaattgaatattctttattctcatcaaagaattttttcactctagagtaattcacatttaacctcacatacatttgattttggtttgcaattcatcaattttattaagttcatactcataatcacagttttcttctaaaacaaaattcatagtttcaaagaaacttttcgcattctttaagagtgattcaaaaaaatcaagtttcggtagtaatactttttgtttttggtcaatttcaaataacaacatatcattcgatattgatttcattttcaatagaaggggttgatctggaaaataagtttcgctttttcctgtttcaatagcttcttcaattagatttaaaaaataagcccacaattggtcaaccaagtcccacatagtgacatcaagcaaatcttgttcaccatattttaaaataatcgccccagataaatagtaagagtctaactgtggttttatgttctttagtccctctatattgctaagtggaacaaagtaatcgtcaatattattttttaagattgaaagatcgtttatcttcttatttggcctaagaattaatgattcaatataaaacattttacctctcctatttttccggatagaattgtcctactcttcctttttgaaagcctacaacatattgttgaccctcatatgatcctctaatttgataactaaatttagttccttttttcgttaactcttcacggttttgtttcataattgattctatcgcatctgcaacatcgttaacagtcatctctttattaagaaaagattgttgagacttaattgaaccatcccataaattaggatgatggcgctctaaaatatgcttcattcctcgcttatcaatgaggaatgattgtcccccaaaagtgtattttctgctttggaaagtttttaattcgtttacaacttcatgcggcttagctttctttaatccttgtacagtagacgaggccttgaatatttcaagtgcagagtttttataattctctccatcaattacgttaaaaggaaaagtccctgaaccaccagccattgcatactgttgttcaaaaacatttggtattttaacgtattcaatacctttttttattcctgcttttgaagcttcaagtgccttaattgcagcaacttttgaaccggcttttgcaactttggatactttatcaatacctttcggaccaactattgcaagaacaacagtactgcctacataggaaacccattttgctctgttgtagctatctccattaatcatatcacgttgaaatgtgtcttctatgtcttttgctatgatcttataagtatcgattggatgtaaggctgcgttcacagttccagaaagcgtttcaatcgggtgtcttgcaagttgatagagacccatcactgtatctttacctgcttcatacattcccattgcaataccttttccaatttcagctttttgttggagttcttcgagttggcggaaataaacttgctgctcaggttccaaattctcgtatcctattttcttcgcaatttttaaatactcgtctggatctgttacctttacaagctgtcttttcaaatcttttatttcgttttttttagcttcttcttttttgatcttcaaataagcttcagattgcttctcgatatcgctttttttcttatgtatatcgctctcacgatatgccttggcattatagtgaaggggtgtagcattcttgcccttacctgttgattcctgtaacttttgaaagtctgctttaatgaattattcgttaggttcagttattgcatattcagtttttaagttttcgtccacatcgcatattttatcaacagtctttttccgtttgttttcggcagaagagagctcatccttaaaagtctctgttgaaaataaatcaagtggaagaatgtcatcgatatcattcagaatatctttcattgctttcttctgctcagacataattgattttgattttttatatgcgtttgttagttcatgttctaagaaggattcctcgatatatgcgtcagataagctggcatcttctaaaacaccggagatactagtaaggaaagcgatcttcatttcaattaaatcaatccattgatcagtgacacccacatgatcgtgataaaatgctttgatattgtttgctcccttgccagagaactcactgtcatccagatcagcaacagccttaaatgcttttcttagcttaatcatttgatttttcaattctttataatctttgcgcggttttcagcttcagataacaaagacttagcttcaaataccttcattgtccaatcctttcagtgattttatatctaaatattaccatggataagttatgaagttagaaaaaattatttaaggataggtaatgaattgaacgaaatgagaattcattggtgtaaaataagcttacatcccatttattacatatagagattggagttaacaatgaaaaaaagtaagtttattttagcgagtattgtttctgttgggctgctagtttttttagcatggtttatttatgctggcacccaccaacctcctattttgaagggtaattcaaaagatggaaaatggagtgttatctattctcctgaaaaagacatagatcttgcaaggcaagacttatgggcggttcatattacatggaaaagggattctgagttttcaataaaagaggttgtgtttaaagaaaatggtgttgttgaggcatcaggtgacgcaacagatgaacctaagaatgctaaaaaaatagcagtagcgataatgggagatccaccaaatatgaataatgattatacagtagaagttacttgggaagagaatgggaaaacacaaaaagacattatacaagtaaataaagaaatcaagcggtcttttgttattcctaatgtaataaaaagaattttaagtttaggataaagctaaaatactctcatggcataaaaatttttaaaaagcaggtaaatagcgcctgctttttcgtgtttaatcttaatttttcaccttaactgattacttcgagcagggctgttactaagtaaacatcaataataaggtaatttttttaaaaagaccgctactccaattttactcctcaatatgaataaatcattataaaactttataatcaatataaataaacactgatatataaaggttttataacagaaaacaaagattcactttattgagggcccagtgggggaataacccgtaaaggttcaagttctctcgaccgcatcccaataataccaagggcttaaccatctttggtgttattttttgcggaaaatacggcaacaaatgtaccgcattgtggagtcgactaaaaaagtgctgacctctgcacaacatcgttgcgcgagtctgcacttttattctgcgattatggggagtttattttaatccgttgttagccgcgccgatacttggcttttagaaactttttttaagtggctaaaaccaacaaattttttgccttcttcatcccataggcggaactttaacgacttaaggcttgttgccagtgtaatggtcggaacgttttgcaatggttcagtgttgttatgcactttttcaagcttatagtttgggactctcgggcttaaatgatgaacatgatgaaaaccgatattgcctgttagccactgcatgacttttggaagcttataaaaagagcttccttcaactgctgcttttacatattcccaatgctcatcttcttcaaaataagaatcctcaaacgtatgctgaatataaaacatccaaattccgagagagcccgatatcataaaaatcggcacctgaaccagcaagaagttttgccagccgacagcccaacatattagtgctgccaaagcgacgatccccaggttcgttacatacgtattcatccgttctttgcgttttgccccttgtcgattaaaacgattggcaatcccgaagacgtaaatcggcccaataataaacataacaaacggatttctgtacaaacggtacattatttttgtcttagttgaggcttctttatattcctctaccgtcagtacccaaatatcgcctgtaccgcgtttgtccagattgctgcttgtcgcatgatggacagaatggtcgtgtgcccaatgatcaaaaggatgcagagtcagaattcctgttaatgttccaaggattcgattcgcctttctgttcttaaaaaaggaatagtggcagcaatcatgaaagatgatgaaggttctcactaaaaaacctgccgcaacaacagaaatcgctaacgtaaggaaataagaaatcgacaagctcttatatgccaaacaccataataggaaaaatggtaccaatgtgttaatgatttgacaaatgcttttgtgtaaatcggacttttcataaggtgtaaccagttttctcaaagtccttaggttttgttctttcatattcaaaagtttccccttccctggtgatcttctaagtgtagaaaacggtttatagcctttggaggtccaacgtgatacaccccatatatgataagtattcttcccattcacctgtaaaattattggaaataataaactgatttccagtttattattagcagagtcagccgggatacaaaaggcgtatgaagattatacccagcactttattgggtcaaactctctcaatgctcccccatggggatcgatttatttgaccgtgaacattgattgtttgaggaaaaaaggaatgaagtaatgggtatatccatgagtgactgtttggaaacatctgcagaaacaaagttttacaagtgaacagccctgcttttaaaagattatcttgctcttgaacaagaaacagctgagctattcattaatgaagtactattaagttaaagaaagacactcgtggttcatttttcacgttgttttcaaaccaaagtttttaataggcctcttattctgcgctggtatacacatgtttaacaaataatgccatgaataaatcggaaatataatttgcagttatttccgattcctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggttttatcgaacgcgaaaatggagacgatgtattcgtacacttttctgcaatccaaagtgacggattcaaatctttagacgaaggtcaaaaagtatcgtttgacgttgagcaaggtgctcgtggagctcaagctgctaacgttcaaaaagcttaatcttcaatcgtttatacaaacaggctctttatatagggcctgtttttttatgtctatatcatactcaataaaaaaccctactcaacgttcgagtagggagatgctacaaggtatagaaaaagatttaaaacttcaaaggtttgtttacagtataacatactggattgacaatatgcggaatgtatataaattatttaatgttttgttcaaatataactctttcttttttcacgttcgttactttaagtaagattagatgaattataaaaatggtttcatctagatgttaccaactcgcatatctcttgtatgaaaagaagataaacaattattattcaatgtcgcagtggatatcagaaattcttaaaaataatgaggagatcgattgtttttttctcctggaaataaaatcacttagagatacctaaaacaatgaaagccctacctctcttccatccttacggctccttgtccgtgccagtgtgaatcaggatactaataacaagtgactattttattgagttttttggtaaaacttcaatcttcgcagaagaaatgtaaataataaaaatggattagaatgtaggaataacaaaagaggtcgttaatgttctaaacataacttggagaagatttgcttttcatcataatattccgaaatatcttttgggatgtatctaaccaaaactttttatttgtttttcagtgattcctttaattacttccagttcactaatcaaaaattcatatgcattatccagcatttttttttcgcttgcattaagtgctttttctttcttcatacgcattaaatcacgtacaacttcagcgccttcttgtatttcacctgtttttattttgtccgtgtttattttatacctttgcttccatggcagtaacctatctgattctccatgctgaaaaatgtgcataatgtgttttaatgcaagtatatcggtaactggtcgtatattcgaactcaatattttacgcgttggaatcataactgtcatattactgattgacattcttatgacataatactgttgtttttcctctaagaattctttttcttctatggcttcaattatacctgctccgtgcattggataaacaatgttatcgccaatttgaaacatatcatccacctccatatatggtaaccttcttaagattaccatatatggaggtgtaatatcaaaattttaataataacatgatcgaatttttgatgtcaataacttttttgaaaaaacagatcaagcaaaaacaatagggaacgtgtcggatttccaatcaggaaaaggtcaattgatccgtgtgatcagtttttcattggctcaatgacatcacagaaatgatttgagtagaaataagaaggaacgataattgtgaaatgtcagctaaaaatattaaaagcacatgattaagttctaatttctttaccgatttgatatggataacggcccacttacttaattacttaatgatgcattttcacttatcttgcgaacagaaaaaggtttgtggatattgaacattttgccaccgagattggcattattatcatggaaattgacaaccttcaaatgggtattgaggtgaaaagaaaaataaagaaaggagagattataaatgaagaccagaacataaagaagtgaaggggaaagaacaaggttaattgaaaagcaaactatataaaatagtttgctttttttgttatgaattcacttctttttcttactctttaatgactaataaaacaccgctaagaattaaaaacgaacctatccaaaatgtcccgcctatttgttctctcagcagaatccatccgagtaaggttccaaccagaggctgaaaaaagaaaaagaggcctccacttgaggcatttaataattgtaagccgcggttccacaataaaaaagcacaagcggttgaaacaattcccaaatacaaaacaccacctagaattttagggtcatgcagttgtggcgtaaaaatcgtgctaggggagtatcattaacagggactccatttattaatagaataaaccttatgaattaatgtctcatatgaatttttttgtatgataatggcgtcatattcatcgcttgttgaaatttacttatgaaataactggtactgttaaatccaacttgataagacacttctgtcacattggattcagggtgttgcagtaataataagcttttttgaattcgataatccattacataacgtaatggcgtcttattcagcattcgtttaaaataacggcagcactcagaacggctcagttggccagcttttgcaatgtcctctaatgtgattttttcagcataatggagatggatccagtttaacatttgtttcattcgatgactttttatcatttcagattgatcgtactctaattgaaaaccattaacgaccatgtttttccacattaacgttaattgcatcgtaatgtcaatctcatagagcgatgtcttttgttgaatcaattgatttatttttttaacagcatctagaatattttttgcccactgttgatttccatacaaaaataaatagggcaaattggttgaaaacatatagggctgaacatagcttgaatacagttcctgagataaaacgaaatggggtgacacatttaaacaaatatacgtacaatccgagccttccttttcttctgccatgtgcaggcagccgctattgataaataatccatccccttcgtgaacctctattttttcttcatttatttgaaagagagctatcccttttagtatcaaaacaaattggatttcatcatgccaatgaagcggaatatagccatttatattttgattgatcgttgtcttgtaacaggcaactggtaattctaccgttcggtgctctgttaattcttttaaattttgatcgatcacaaaattcttcattctgacttctcacctcaatatatttatattttttcattcgatttgagtattttttatcctattttgcatttattataacactattattatatttattagtgaggagtcatgtatgaatacttccaatagaagaatgggattgttctatgttatcacaggggcgacatgttggggaattggaggcacagtagccaaaaaactttttcaagaatatcaaatcgatgtcaattggcttgtaacgacacgcttgcttacggctggaatgttacttttaatgctgcaactgttcagaaaggaccggtctcaggttattgaggtttggaaaaacaaagcgtcggctggccagctacttatttttggcctattgggaatgcttgctgtgcagtacacatatatggcatccattcaacatgggaatgctgccgttgctacattattgcaatatttatccccagtaatcgtcattatctacacgcttttgcgaaaacaaacggttcttaccaaacaagatatcattactgttgtacttgctttagtgggttgcttttttttgttaacaaatggttcaatgtctcaactttcagtgccggcagctgcagtagtatggggagttttatcaggattcgcggcagctttttatactttgtatgccgttggtttattaaataaatttgattctcttgtcgttgtaggttgggctatgattattggcggttttgcattgggttttatccatccgccatggcaactggattttcaacgattaactgctgaggcgtatgcatatattttatttgtgatattatttggaacaatgattgcgttctggttcttcataaaaagcttggaaagcctctctcccaaagaaacaagcctactaggcagtctagagcctctatcagctgttgtaacaactgtcgtttggttaaaagcgccatttggttcttttcaatggattggtgctatttgtattatagggataactttaatattggctttacataaagagccttctatgcagagtgaaaaatccttattaaagattaggaatcatgcaaatcgggatatataagggctttttttgcttacatgaacggtccggcaatgaaaaacactggtggagatgagccctctcggcagtatcaaaaataccaagggttttgacgcccttggtattttttcttcaagaaccttcaatttttcttctttgatcgaaaaacgtattacttttttgtaattagtatccaaatttcacttttaaaagatggtgatgttacatccttatgctcgttccacaatatttctggaccttctatttgttcgtaatttgacgatggaaaccattcggaataaatgcgtccccatacttcttgcagtgtatccggaaatggcccgattgattcgaatacagcccatgttgaggcaggaacttcaagccgtgagaagttatctggacaccgtttcgttgtggctgcgccaatatagtgatcgagctctccgttttcctctgtccgaccttcagaaaaattcgtggatgcactaatgaggcctgatggtgctacattagatagctcttttagtttatttattgctttttcatctaaactttcccacatagatgcaatttccggattaattcctttgaaaataataggaactctttttttaaagccaacgatgcgaaatgcctctttttcttcaatacggtagttcatttcatttcctcctttaattgttagctggaaggtcattcgtggataagctttaagggaatggccattaagtctggcttttgatgggtttatgccatgtaaattttggaatgcccgtgcaaaagaatctggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcattagtgaggttttcttcaatatactttaacgccctattcatacttttaagcaaatccatttatttggcctcctttaaccaaagaataacaggagtgaaatgtatttatccgacattctgtgcacagttttgcaggatgacttatatgaaataaagtaagtgattcacttgtatttgtacaggttttattgaagcatgctgttcataaaaaggcatcaataaaagaaagttataattgtcttataaacggcacattcatataattgagtgaaaaaggatgcgtatcatgcctatcaattcttttgaaaactatccgatgagctggaagccatcaattgataaagctgaaaagcctatctataaagcacttgcagggcaattggaacaggatattataaacggagttttaatacctggaataaaacttcctccgcagcgagaattggccgattatttagatttaaatgtgagtacgatttccaaagcatttaaagtgtgtgagttaaaggggctgctgagtgcgactgtagggagcggcacatttgtatcgtatgatgcgttgtcgaatgcgtatttacttgaggatacaaagccaacacatttaattgaaatgggagcgacacttccagatcacgcttcatatgagcccttgttactccaactgaaaaacatggttcaggaggaggattatgaaaaatggtttagctacggccgggctggcgaaagcctttggcaaaaagatgcagctgtaaagctcatccaaagaggcggatttgaaacatccgttgatcacattttatttgcaaatggagggcaaaatgcgattgcagcgacattggcgagtctttgtaagcctggagatcgcatcggagttgaccatcatacgtaccctggattaaaaactgttgcatcattgcttagtgtgcaaatcgtaccgataaaatcagaaaacgatgaaacgagtccggagtcacttgaatatgcgtgtaaaaacgaaaatattaaaggtttgtatttaatcccggattatcataatccgacgacttcctttatgtctgttgagaatcgaagaatggttgcagacattgcaaagaaatataatctgtttgttattgaggatgcatcgtaccatcttcttagcaaaaagccgcttccggcactcgcctcattcgcaccgcaacaggttattcatattgcaagtttatcaaaatcgttagcgccaggcctgcgtttggcttatgtagcagtgccgagacaatataaggagccaatatcaaaggcgctttataatttaaatataaccgtttccccgctattagctgaacttactgctcgtacgattgtatcaaatcagtttgaagtcttaattgagagtcatcgtgaacaaaccattcgcagaaatcaaatcgtaaaccgatatgttgcgggatatacatgtttaggtgttgaaacaggcatttttcgttggttgatgttacccggtaaaataactggcgctcaatttgaagagttggctgctcgacatggcgtgcaagtgtatgcggctgaacgctttgtagtaggcaatagttgtcctgaaagggctgtaagggtttctgtctgtgcaccaaaaacacttgaagagcttgaacaaggattaatgatcctgagacgtttgctagacgatcttacctaatattgtttgccatacaattatgacattgtatggcttttttgtgcgtgttatgatgatccacatctagagggaggtttatacaaaattggcttttagaaaggaaggtcagatgatgttagacaaggacagcgtaaaagcaatagatgttcaaactgcttcattacaaagctacatcagttcaccagaaaaacaaaaatcgttatacaaacgtactttattcgttgtgagtatctcacaaatttttggcggtgctgggctggcggcaggagtgactgtcggtgcacttattgcacagcaaatgcttggcactgatgcgtttgctggtctgccttctgcgttatttactttagggtcagcaggatctgcattaattgttggaagactttctcaacgttatggccgtcgaacaggtctttcggctggctttatgattggcggacttggagcaataggcgttattatggcagcaatcataaatagtattttcttgttatttatttcgttgcttatttacggtgcaggtacagccactaatttacaggcccgttatgcaggtacagacttagcaaatcataagcagcgagcgactgctgttagtataaccatggtttttactacatttggcgcagtggcaggtccaagcttagtgaatgtgatgggggatttcgctctttctattggtgttccatcacttgctggccctttcattttagccgcagcagcatatatgttagcaggtgtggtccttttcattatgcttcgtccagatccattagttatagcaagaacaatagaagcggcaaatgaagagcctgatgataaaggacatttggcggcagctgagcatacagaaaacaaaaaaggcatcattgttggggcaacggttatggttcttacccaaatagtaatggtagctattatgacaatgacaccggttcatatgagacatcacgggcatgacttgggggcagtcggtcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactgggattagggtggaattttggtttgataagcgggactgcccttattgtagattcaactgatactgccacacgagctaaaacgcaggggacagtggatgttctgattgcgttgtcaggggctgctggcggagcattatctggaatgattgtggcaggttcaagttacctagctttatcatttactggagggatgttgtccttattactcattccagtggtggtatggtttaggggacgataaaggataggattgtttaatttacattaatttgttatattgttagataaagtctattgcgtcgtctaataatctaactaactatagttgctccattaaatctaaatcagcaattttggtataaagatatgtgaccaggattccttatagctgtgtcactcactgcatattctttaattgaatcacataaaatggttatcggatttgaaaaaggcaggattactcgctttaggtaaaggagtcataacgttgttaaaaaggttttctcttgtttttgttacactaatgatgtctatacttgttgttttagcggccgctaaagagtcgcccggagatcatgtcatctcatttgatgaacctattatcttgatgatctcaattggaatcgttgtatttttatttatccctccattagtcatgtcctttttcggcaatttggttgtaagaataatatctggtgtataccaatgttttatcgttttcacttttctggggctcattccaattggatttcttattcccaatggttttttgacaattctagtttctattgcaggaactttagtcagtatagctagtttggccgtaaccttatgcattggcaagaataaaaaagatatataatcatcgaattgttattttttcagattgtcagtgaaataattatacaaaaagagaaggcttgtgggccttcttttttttgttgttgcatcatccccactttgagcttaatctattgaataataagagaaggaacctatagaagaataaaataaataccgagatgtcaaaaataaaactggacttcattattgtgaattcacgtaaatgtaaaaagattggaaagaggggaattccttcatgacaaatagcagaacaaatccgaaggttgatgaatttttaagtaaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgtttcacaaaggtgccctattacaggatgcccatggaattctcattcaacaaacggagaatgtacaggcggcgcgccagattcggtttacaaatgttcaggaaataaatgagctagaaaacattttgaaagcctatattcacgaagccattgaagttgaaaaagccggtttgaaagtggaagttaacaaaaatattgaattgaacattcctgaagaacttcaaaataaattcgatgaaatccctgccttgaaaactgcttttgaagcattgaccccgggacggcaaagagcgtacactctttatttttctcaagccaaacaatccaaaacccgagaatcgagagtcgaaaaatatgtgcaaaaaattctcgatggaaagggattaaaggattaggcacgccaaggttcaggctaaaggaatagcatcatagcgtaataagatcctttctatagaagaaaaacaagcatagtaagatgcttgtttttcttaggacaacattcacttactgctgaaatgcttcttttgattaacattgtatgccactagacagcgttataaaatattaatgcaacacctagaaatagctcaatggcacggctcatcacatttagaatgcctaggagaactaatagaaccggaagatttttagcaagttactacactccaaactttgttttttgtattaatataccttattaaccattgtttttagtcaggtgcagacaaacgaatactgattaatgaatcttcatgatatcgatgatccgcttgattttttcattgtcacctgtatcaacatacactgtttttctgttttttatgatattctcagtcacttccctcatgacgcctttttctacatcatcagcagaatcccatcgtaaaggcacattatatacatgaatcgtgccatccccattgccatgataagtgactgatccatccactaaacgagaacctgctaactgggttacatcttctggatagctggcacttgtatcatcattaggattaattggctcgccagccgaaatatgtcgaacatttaattcatctatctcttgattaggtccaagttgaagccaaactctggcatattcgattttttccgaagagtatgctgccaatacattgtcttctttgcttttctcttctgctgaagaggtatcatttgcagcttttgttgcagattcttctgattctgttatcggctccgcttcatccttgcgtattttggtgttgtcttcaggctcagtgtgtttttcgtcagattgcacagcagaagcttgatttgaaggttgttgtgcttcttcatccttactgcccgtacatccagcaagcaaaatcatgagcagcaggacagtaatacaaaaatatatctttctgtgtttcttcattctttcattcctctccattaattcaggtcagcttcatatataagtttatgtatctaaatattaccatggaatagataggatgatattgaaaactgtttaagaagaggaaacgatcttgaatagcatcgcgaaaacctaagaattttaagaagttttgcccctttttcttcaggtattgaatgtaaagtgggatataaatgcaaacaaaaacgaaatgccttatccgcctcgtgtcatggcagaaaaagtgggggatttattagagaggattttataatggcggcaggtaaatgggtgttgacttatatgtctaagcgggagactcaagtctgctcgatcgcgtgcaaaataccaagggccagcaacccttggtatttttataccttcatgcatttttgaagtttacgataaaggtctgccttactttgcaaatcgccgtgcagcagcaacgcacatgataacggcgatattcactgctacgagtgcccagcctactttctcgtgcagtatcactgaggcaagcagcagtccaaaaaaaggctggagaagctggagctgcccaaccgctgcaattcccccttgggcaagacctcgataccagaacacgaagccaatcagcatgctgaataaggatacatatgcaagactgagcagcgcgggaacgccgatcgccgaccatgagtccggcgtaaaaaagaacgacaatggcagcataagaggaagcgacagaacgagtgcccatgagatcacctgccaattccccagacgccgtgaaagccttgccccttctgcataaccgagaccgcatacgacaatagaagccagcatgtacgcgtcgccaagcggggatgaacctcccccctgaatgagggcgaaacctgctactaacaagctgccaacggctgagaaaatccagaaaacggggcgggggcgttcacccccgcgcagtacgccgaagaccgccgttgcaagcggaagaagtccaatgaagacaatggcgtgtgcggaagtgacatgctgaagcgctaaagctgtcagcaacgggaaaccaatcactacgccaaacgctaccactaataatgaaatgaggtctcttttggaaggatgctgctgccggaagatgagaaggagacctcccgccagtacaccagctatcgcagcgcggcatacggtgaggaacagcggatcgaagtccgacacagccaaacgggtcgcaggcagcgagccgctgaaaatgagtacgcctataaaaccatttatccagccatttgttcgtttgttcattacaatcactccacatatctttcttgttcattgtctgtattttcttaacaaaaccagtagctaaggattacaatgactataaactggaattggccttttataaacagccagttttcataaaaaaatgcataccagttaggagaacaacgcgcaaatggatatcacgccttttttggatagaactctggatattccgctttatcagcagctttacagatattttaaagaaaacatgcatcggggccgtattcaaaaaggaatgaagcttccttcaaaaagactcctggcgaatcagctttccatcagccaagcgactgtagaacgtgcctatgaacagctcgctgctgagggctatattgtgagcaagccaagaagcgggtggtttgctgattatcatgattctgattttgcttatgatagaatgccaagcacaacacccattcaacaagaagcagaagaaaataaacaatggattgattttcattatgggaatgtagattcttcttacttccctttttccgcatggcgaaaaagcatggtcaatagcttagaccaatatggacacgagctttatcggccgggacatgttttaggagagtttgagctgagaacactcattgcagagtacctgtatcaatctcggggtgttcattgcggccctgaacaagtgattataggtgccggaaaccctattctgctgcaaatcttgtgccaagtttttgagccgaatatttctatagggtatgaggatcctggttatccaagagcacgcaaaatttttgaagccaaccgcatgaatattgttccgataccagtcgatgaggaaggaatctgtatacagaagatcaaagaacagcagccaaaccttgtatatgtcacaccttcccatcaatttacgctgggaacaatcatgacgatcaacagaagaattcagctgctcaaatgggcggccgaacatcaatcctttatcatagaggatgattatgacggggaatttaggtacacaggacagccggttccttctctgcaagggcttgatcagcataaccgtgtcatttatatgggcactttttctaagtctcttttgccctcgctgcgtatcagctatatgattcttccttcgcctcttttaaaaaaggggcatgaaatcacgtccttatataagcaaacagtgtcctgccacagtcagctaaccctagctgaatttataaaaaatggagagtggcaaaaacacatcaacagaatgagaaaactttaccgcaaaaaaagagccattgtattagaggcagtgcaaagggaattaggagagcatgtcagaattcgcggagaaaactctgggcttcgtatcttacttgacgtttatttgccatttggtgaaaaagagttaattgagaaggcgaaaaaacatggagtaaaaatttatcctgtttctctttcttatcaacatcatcctcctacaaaaacggtctcgctcgggtttgcaggagtttctgaatccgacataagagaaggcataaaaaaactgaaggctgcctggaagatatgagggagctttcagtttagcaaaacggccaagtgacgactaagtgttgagagctgttcaatattttttaagtatatgatgagtgcctgcagttcaggccacgatacgtctgtttagcgaaaaacagaattttttatttgctcatcacagtgctaaaataaacaaaatagacaattgaaaaaatagaggtgtaagaatgaagttagatgagtttacaattggccaggtcttcaaaacgaaatcattaaaagtatcaaaagatgatattatgcggtttgcgggtgaatttgaccctcagtatatgcatgtagatgaagaaaaagcgagtaaaggcagatttaatggaattatcgcttccggcatacaaacactggccatatcttttaaactttggattgaagaaggtttctatggagacgatattatagccggaacagagatgaatcatatgacattcataaaacccgtatatccggatgatgaattgtttacaattgttgaggttcttgataagcagccaaagagaaatgaattgggaatactcactgtattgctatctacttataatcaaaaagaagtaaaagtgtttgaaggtgagttatctgtattgatcaaacgataactcagaaagcccgcttttcgcgggctcgattgaagcagatgggtgaaagatgttagcgagtttcctttgaaaaataagaggttaaaacatcataaacaataggcaaagaagtaaatccctcatcttctagaaaatgacctccgtgctgaacttcatataacgcagcatcaatttgttgtgccagatccttgctgaatgaaaaaggcacaatttggtcgtccttagaagcaatgacagcacggtgcttcgcggactcaatgattgtttgatgatcaaacgatccctgtgtaaattcatctaacatctttaaagtgggcaatgatttggcaaagccggaaacaagtatgattccgccaagctgttttcgtaattgaagatgttccaaaaatctcaaaatggcggggcaacctaagctgtgcgcaaccaaatacgtattttcatgtaaagtgtgctgatataaagagagtgtctccagccgatcctcaagtcttggctggagcggattaggcatgtttaaaatgtctgctttgaccccatctgcgagcaggcgttttttcagccaagggaaccaatgatttgttgaggaggctccgtagccatgaatgatatagacttgttttgtcattttttcctccacacgaagcattttcattcagtataaaattcctctcaatgggaaacaagtacgcacttttttgtaagtagttttacatatgaggcattccttgtgccattccccacttacacatttcatctatgaggggatacaaagatcgccctctgtcagataacgaatactctactttcagtggggtttgagaaacctcagtccgatgaataaggccgtcagtttgcaattccttaagctgtgcgcttaacattttatgggtgattaagggcacagctcttttcagctcgccgtatctcatcgttttttcacaccctaactcatagagaattctcattttccatttgccccctataagagataaggtgtattcaaatggggcttgtttactgcggcacaggttattcattgtaatcaaacctccttttttaagtatcatatcagaataaattaggattttcggtgttgaagtttgagggcgattcacgatctgaagtgaaaggggccgcttgctcaacaggcggcacggtacatgaatgttctaagtcaaagagggttaccttactgttaattactttatttaaaaaaacgcatgtttttagctgaaaatatctattatggtatatttaaatataacgaaatatttgagaaatgaggaatggtatgaatacaaccaaaaaacataagaaatttaaagcgaaaatgattttccaaatcatcatggttatcattggaggaatcatagcggcgtatggactagaaacagtgctcattccaaacagtgtatctgatggaggggtgacgggtctgagcatcgttggttcacagctattcaacttgccgctggggattttgattgctgtgatcaacattccattcgtctggttaggatataagcaaatagggaaaagctttgcattattatcaattatcggaatcgtatcgcttgccgcggggacaagctttttccaccacacacccgctatcatagaaggagataccctgttaattaccgttgtcggcgggattatccttggatttggaatggggctggcgctgcgtaatggcggcgcattagatggtattgacatgcttgctgtgctgctatcccgaaagctgcccttcggaacgagcgatctcattctattcttaaacctatttgtgtttatttttgtttccacagtatttggcttacaaggggcattgctttcagtcattgcttactacattgcatccaaagtgattcatgttgtggaggaaggcttaagcggctctaaaacctttcaaattattacaacccaacctgaattaatggtagagacaatacgtgatcaattaggccgaagcgccacatataaagaagcttacgggggtttttcccacgagaaatttaaagaaatcacatgtgtcatcaatcgtttagaagaaaccaaactaaaggaaattattaatgatattgataaatccgcctttgtcaccgtatatgacgtagctgaagtgaagggcagcaattttagaaatcttaatcatcactaaaaaatagaatgacctttttaaccgtaactgacatgccgcgggtaatttaatcaaaaacacttttttgaggcttgtgggtgaataaccggtgaaggtctcaatcataaataccaagggtatcaaaacccttggtattttttttattttgctaattgctgattgtattatgctttcccgtccgatatccatttcagttactgatttgggaatgaaatgctttgtccgccataagtgttgtcctggccatccttcctgccaaaaaccaaaagcaaatacaagctatattgccgtactcggttcaatgtacaatgggtaaaggcaaataaagagattgatattaattgaatcaaacatatttgatgttccgaatataagggattgtttatataaataaaagtttatataatgacggtggcgctaaggaaacgcggggagcgactcaggttttcgtttttgaaattttgatccttaagataaacggagctctgcatatggaaacgcaaaagggaatgtataaacgtttggcgtgtatataacgatttgcttatatattgatttgggaaggaggagctcatatgacgattgatgttgcggcgatgagtcgttgtttgaaaacacttagtgatcaaactaggcttataatgatgagattatttcttgaaaaagaatattgtgtctgtcaattggttgatatgttcgaaatgagccagcccgccataagccagcatttgcggaaattaaaaaacgcaggttttgtgaatgaggacagaagaggccaatggcgttattattcaataaatggttcctgtcctgagtttgatacattgcaattgatcttacatcaaattgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctaatagcaggtgttgtcaattttcatgatgtgttaactgtgacagggattgtttggaatgcgacattggcttttgtggccatcatactgatatcgttaattcttgatactatcggtttctttgaatgggcagcgcttcatatggctaaggctgcaaaaggaaacggtgtgcggatgttcgtttatgtatctctattaggggctatcgtcgccgcgttatttgcaaatgacggtgcagcgcttatattgacaccaattgtattagcgatggtcagagcattacattttaatgaaaaattagtttttccttttattattgccagcggatttattgcggataccacttcgcttcctttagtagtgagcaatttggtcaacattgtttcagcggactattttcatattacgtttattgattatgcatccagaatggttgtcccgtacttgttttcgctgctggcgagcatcattgtactttaccttttctttagaaaaagcataccaaaacgctatgatctgactgaggttaaaaaacctgttgaagcaattaaagatcaaaacatgttcagactgtcatggtatatcttagggctgctgttaattggatattttgcaagtgaatttttttctatccctgtatcagtggtagcgggcagcattgcgatcattttcttaatcgctgcgcaaaagagtccggccgtccatacaaagaaagtggtgaaagaggcgccatgggctatcgttttcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccattatgaataacttgccgactgttatgattgacgcattggcgattgccggtacagatacacatgggatgatgagagaagcgcttatttatgcaaatgtgatcggttcagatttaggacctaaaataacaccgattggttccttggcgacattattatggcttcatgttctttcgcacaaaggtatgaagatttcctggggcacgtattttaaaacaggaattatcctcacgatacccactttattgatcacacttgtcggcctgtatatttggctgctgataatccattcttgtttctaaaaggacaaggtcactatatcaaggaaaacaatgcactggtaactcttgccgcagccaaatggctgaagggtgggggagaaaataccttggggacaattggaatgtgtacagcgcaggaatcgaagctcatggatgacatctgaaagctgtcaaagctatgaaagaagcagggattgatatttcaaatcaaacatcggataaatttgatgatccggcaaaagcacacggaacagaagaagtgtttccaaagggtccgtgatgaaattggtgaccgtttaaaacagtttgctgtaactggggaataaagaatcgatatactcagcgtttccttgggttatataatgcaatgtgttgttcaacaggtgtctgcgagctgagtgcagacacctgtttttgtttttatttgtctgagattcgtaacagggaagttatttagctggtgacagaggaaaattgatttgtgaacagaatcatgaaggagacggtgttttaaaggagttgtctgttttgcaggaattaacaaaagaaaaatacagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaggatattatgaagaacaagtgaaatcatcaaaacgatttaccttgttttcttccagtgatacatgggatagcgtactgaaacccatactgaaagatgacttaaaccaaatgagaagagctgcattttcttatcaaccaaaatctttcaaaaagactttgcaactgccaaaggggcttgtattgaaaagaattgacgaagacatcatttcacatagcacagcgtttaacagcgcgtattatgaggagtattggaattctgtctcacagtttgcttcaaaaggttttggatttgccgtattacatggcaatcacgtagtaagtgagtgtacctctatatttttagggcataatcgagcggaaatggatatctatacacttgaagaatatagaggactggggttagcttattgcgtagcaaataggtttatagcgttttgtatggaaaatgggattgttcctagctgggattgtgatatttgcaacaattcgtccattgcattagcagctaaactagggtttaagacggtaacggaatacactatttactactctggctaaccttaatgaaagaaccttaaaaggagataccaaccgatgttggtatcttttttgttttagagtttttttacccttttagcagaaaaatgggtgatgaaaatcttattcattttatttacttttaggtaggtaaaacataccccgccaactgtaaccactccgcctagcagagagagcagtgtgggtatctcgccgatccagagccaagatatgatcaaggctaaagccggtgtaacataaagtgaaagggttgcttctgaagcaccgacgagtgaagtgacatatgctagtgcgaagtaaggaataaccgtcggcaataatcctaagtacacgatagacaaagttgcgcttattgaagcgttcatcatctcttcgcctaagcctggcagaaacacaagcataggtattgttccgccccaaatggtgaatgtaacgaatggaataaaaccatatttttttatatagcgggcttgaaaaacgaaataaatactctccgaaaatgctgccagcaggatgaccaagataccgctcattgaatatgtaaagtctcccgccccaaatgcaatcaataatacacccaataaactgatcatagagccaagccatttcgtaaatccaaaatgctctttataaaacaggcgggatagcatggctgagaagatcggtgccgtagtaacgagtaagcttgcaactccggcactaactgttttttcaccgatgttcagcaaaatgtgatagaatgcaaatcctaaaaaccctaaaagaaaaatggcaggaatgtctttcaagtcgggtaggcgcatctgagtcaaaacagcaaaaagcaataatgccatagagccgattaacaaacgaaataaagcaaggtgttctggcgtgtacccttcaagtcctgcgcgaattcccggaaaagcagatgcccataaaccaatcatgagactatgagatataattatttgaactgttttctttcgcattcctctcactcctctttacaaaaaccaaccagttatttaatgtgtttctatactaataaagatttgatgatatggcttcaaccagttcaatagattttgacccaaccaatttattttaaggagaccgattctatgagctttccagaagaaaaaaagatgaaaaagctccctaagtacagacaaatcgttcattttattaaagagaaaataggaaatggcgagtggccgattggaagcaagattccaagccagcgcacgcttgcaaaagattttcaggtaaatcggagcacagtgattacagcgttagaggaattgatggccgatgggctaatagaaggcacaatggggaaaggcacagttgttatcaacaacacatggacactgatggctaagaattctgctcccgattgggatcaatatgtcacctctggcattcagatgccaagccgaaaaatcgttcaagagataaatcaatcagaatcaaatacagaccttatacagctcagtaaaggtgaactttcagctgagatttttcctttggctgttatgaaagagatgatggggaaggtatctcatcacatggaggcattcggttatgaagaaccaaaaggttacttacctttgagggaggcattaagcaactatttaaaaaccattggaatcaacgtctcatcttcttccattctgattgtctcaggagcgttgcaagccttgcagctgatatcaatggggctgttacaaagaggatcaaccgtttatcttgatcagccctcttacctttattcattacacgtatttcaatcagctggtatgaagctgactggacttcctatggataatgaaggacttttgcctgaaaatgttcatttaacaagaggagagcggggaagggctatcttgtatacaaatccatgttttcacaatccgactggtattctcatgtctaaaaagcggcgtgaagagatcctagcagtaagtgagaataaacagcttcctattattgaagatgacatttatcgtgagttatggatcgatgaaattccgccatatcctattaaaacaattgataaaaatggacacgtactgtacataggaagtttatcgaaaacattaagcccaggtttgaggattggatggatcgtcggaccggaaccggtgattgaacgtttatctgacattaaaatgcaaacagattatggatccagttcgctatcccagagagtagcggcagagtggtttacttccggccactaccagcagcatgtagaaaaggttaggcagcaattaaaggtgagaagagaattggccttgagtgctttagaaactcatttgaaagatgtggcgacatggaatatcccaaaaggaggattttttgtctggataaaaatattgccttccatatcaatgaaattactttatactaaagccttatcaaaagggattctgctcaatctcggcagtatctatgctcaggaaaaagggaattatattcgcttatcatatgcttatgcatctcttgaagaccttcaaaaggggatttatgagttgggtttaatgattaaagaattggctagcaggtagtatttattcacaaggatatttcctaaaaaaagatcaagctaatgttggcttgatctggtgagttttattaaacaatttgtttatattgatcgtaaaattgatctatttttctgaacatttgttttataagcgaacctgttataaatggattgaggaacacagcacgcagccagcggtttcctttccattccggcaatgacaagaagatattttcttctttcaataagaactgctgcagttccaggttccagttatcccattgatccttttcaatgtcatgcggtatacctcggaaacagcagatgtttgtatctggctcacaataaagctcaagaaaaggccgctgtttcacttgttctatacattcttcgtttagtgcgaaacttttatttatcaactggttgtatccttttgttccaacgtgttgaagtgataaatataattttaaaatatcagcatgccgcgtgccttgaacacctaattcacccagattaataaaatcagtttcattcatataaggggcagatatacggaaatcagtttcaagtatttcacgatttttaaaaagagtcattgcacaggtctttgtgatgtacatccacttttgcggattaaaagtaatggaatcagccatttcgataccactcagtttatcacgatatttttcagaaaaaattaaagcgccgccatatgctgcatctacatgcagccacagtccgttttcctttgtgattctggcaattggcaaaattggatctatgcttcctgtcacagttgttccggcagttgcgacaacagcaaatggaatgtggccttcactctttgcacgatgaatttttatttctaaatcatgaatatccatgcgggccagattgttgctttttaccggaatgatactggaggtacctaaacctaggatcatagctgctttgtgcagggaggtatggctgacgtccgaaacaaagatgacaggctgtccagaaagtccgaagatacctgtctttttcatatttaattgatgatttcttgctactgtaagtgcatgcagattagcgagacttccgccgcttgtcatcactcctcctgacttatcatcatatccaaacatacgggcaatggttttgagtaactgtgcttccacttttgaaaaaacaggggacatctcaaggcttagcatattgttattaagggaactgcttatgaagtcacccaagcatgaaatgagagtggggattgaatccatatggcccatatatcttgggttttgaggattcattgagtttttgatgataccctgcaggtttaccaagatattttcaatttctataccagtttcgggtatatcactataatcaaaagactccacagcaggcagtgtgtctctctttgcagcatgactcgaatgttcaataactaatccggctaattgatcgactaagctttttacttcatttgtattatgtccattagggtctatgaatgtgtttttaggtagaaaagataattccatcgaggccgcacgctcctgtcattacaattttttcaattatatcatgatgacagcatgacaatgacgtgtgcttttatctattataaaaatagaccaagtcttagcttggtcttaaaaagatcatgtctctgaacgaaaagtctttccgacttctcttcctaaaccaaaataatgtctgaaattatagataagcgggctccatttggaagggttgatatggttttcgtctagtataatactttcctcggcatgaaaatgtagtgcctgcgtctctacaattgcgaatgacgattcatattctggaagccgaatgtgtttcacttcggcttctatttggatagggcattctttgattcgtgttggtgatactgtttttgattgtaaaggcgttaaccctgctgcctcgtatttttcttttttatatgtaaatccgagctgcttctttaaaggcggtatgcttttttttccgctataagatgaaattctttcaacgttttcccataattccgggccaggcaagtttatgacacactctttgtgtctttccaaattgtcgatggcttttcctcccagtcctactccaaggattatataatgtccaagagcccaagaagaagacataggactaatattagtggttccatcctcattcaatgtggttagaagaaatgtcgaggtaccataatacatgatcttgggtttgatttccttaaatcgacgagtgtctcgttttttgatgtccaatgttttttcctccttgtcacgcttacatttatattgtaaaggattaacatttcaactatcatcgaaatatgaatgtaaggaggaaaatcatgaatcctaatattgcaaaaatctcttcgctgctatcagatccctcgcgttcttccattcttctcagtctgatggatggaaggatacaccctgcgggagagcttgcatatctcgctaacattaaacctcaaaccgccagttttcacctgaataaattgcttgaagcaaagctgattagcgtagagaagcatgggagacatcggtattacagattggctgactcagatgctgcaaatgtgatcgaacaattgcttcatattgcgcctaaagcaaaagtcaaatctttaaaagagtcaaaagagaaaaaggacttgcatttcgcccgtacctgttatgatcatttggcaggttatgtgggcgtgcaaatggcacattcattagttgagcaggggatgttaaaaaaagttgatttaaactttgaggtgacttcagagggtgctttattcttttcaaagttaggcatcaatgaagagcaacaacggaataagaggagagcttttgcccgctgctgtttggattggagtgaacggcagcatcatattgcaggagcattaggaaacgccctattggtgcgcatgttagaagaagaatggatcgttcgtatgcctaaaacgagagcgattaggattacacaaagcgggaaaatcgcgtttgaaaagcacctaaacgtgaagatttaggattttgaagcggaaacaccagatgatgaggcacgatatctaggaggagtaagatttgttctaatcttactccttcttcttattttgaagcagctcgattccccattgcaatagagatgcggttccaactgtttatttgattaatgatgagaacaaggtcaacatattgtttttcatcataatgttcccgcacccgatgatatagctcatcaggaacccttttagatggaatgagcgtgatgtgttcagatagttcgagagccgctttctcttcaggtgagtaaaaatcacattcattccaagcatgtaaacagtaaattcgctgttcagtttcccccattttgcgggcatcggacgtatgcatatctatgcagtaggcacagccgttcatttgagagactctgattttgattagttctctcgtcgttcggttaattgaggattgtttcgtgtatttctccatatccatcatgattttcataccttcaggtgcaatctcatagtaggacactctttgactcataaagcaagactcctttccatagaatacctagattgtatctcggtattgatcattttaccaatgtgcggtttgaatgacagctgtttcagcgtcttttggaaagaagcttctttgaataaaaataagggtagccagcaatgatgagtggagctgctaatgcaagcagtatccatgagcctgattggctgtctctagtgactctaatgaatatataagtaccgatcagaaaatataataaagcacctagaaaccaatacatgttcattcctcttttttcttgctttttggttgcgcatttttgtctgtcatatggcttaatcgatcagggttctgattttttaataccttttcggtccggattccttttctctttaatgataaaattgtgagatcaatcgatttcaatgatgatcattcaatgaatagtaagttccttatgattttaaaggtaaatttgaaaagataaaacgtacatagaggcagaacgttcatgtacgtttgggcaatgatcacttgttggaaactctaatgtttccctgcacctgatattgttgtgttccttctcttcctataaaatgattggatacatgtatgtttgcacgttgaaatatgagttcgattttcatgaatctctattcggtgaaacaggtaaaggaagtggataaggtttgcttataaggaatccttttaaagataaatattactcacatgataggcgggcattaaacatgcttgcactcagagtgccgggcctggcttttattctcatgatctatatagcctctatcgtgctgcaatttgtttctggggggtggtccattttattgctttatgcgtttaccatattaatcgccatttttgctttgcttcattggcactcatatcgctgggttaagaaaagagtgattctgtatttcgcggtacaaggtttgatcacctttgcacttgctaatctcatgactggcttctttatacttgtgattatcggcctttatgcatttttaattggacaaattataggaatggcagacagaagaaggacttttctcattctttatctattgctgctgctggtcataaattcggcgtatcaccttcataaaggtgaagttttgcattttattgttattgctggtccaatcatgattgtcatcatcacttatgccgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgttcatctcgccaaaggcaacacagagagagcgaaggaaatcatacaacaatcgatgaaaagagtaaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcaccaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgtgtcagggcaataaatggccaattcaatatcaagagtacaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgaattagaaccggatatcattctgatggatttgtatatgccggagatgagcgggttagaggccattaaacaaataaaagaaaaacacgatacccccatcattattttgactacatataatgaagatcacttaatgatcgaaggaattgaattaggagcgaaaggatatctgttaaaggatacgagttcagaaaccctttttcacacaatggatgcagcgatcagaggaaatgtgctgttgcagcctgatatcctcaaacgtttgcaagaaatccaatttgagcggatgaaaaagcagcgcaatgagacgcagctgacagaaaaggaagtcattgttctaaaagcaattgctaaaggtcttaaaagcaaagcgattgcctttgatttgggcgtctctgagcgaacagtaaagtccagattaacgtccatttacaataaattaggcgcgaattcaagaactgaggcagtaacgattgccatgcaaaaaggtattctgacaatagacaactaaactgcatatttgaaaattgcccaaacgtacatgcccgaatgtacgtttttttcatttcattgtcaactacaatgagaaagaatgtgatcaagcaatgtgttgaaaggagattatcatgtcaaaaatgttatatacattaggaggatgggttgctcgcaatcgcataaaagcaatatgtgcgtggatcgttgtgttagttgctgcgataggccttgcagtcaccttgaaaccaaatttttctgaggatatgtccatacctgacacaccttcggaaaaagcgatggatgtgattcagaaagaatttcctcacggtcctgataaagggagcatacgggttattttcggtgctggtgatggggagaaacttactgggaagccagcaaaaaaagcaatagaagatacgctcaaagaaatcagtaaagatgattctgttgactcgattgcaagtccttttgtgacagggacaatcgcgaaagatggcacagttgcctatgctgatatcaagtataaatcatcagcagatgatataaaggattactctatcaaacacttaaaagacagtttgaaaatggctgatgatgaaggattgcaaactgagctaagcggagatgtaccgggagccgagatggagataggcggtgtctctgaaattgtcggcattatcttggcttttgtcgttttagccattacattcggttctttattaatagcaggtttgccgattttaactgcactgattggtttaggtgtaagtattggactggttttgattgggacacaagtatttgatattgcttccgtcagtctttcattagccggaatgattggccttgctgttggtattgattatgctttatttatttttatgaaacaccgccagtttttaggcgaaggcatacaaaagaatgaatcaattgcgagagccgtgggaacagcgggaagcgcagtcgtttttgccggacttactgttatcgttgcactttgcggattgactgtcgttaacattccttttatgtctgcgatggggctgacagcagggcttagtgtactgatggctgttttggcttcaatcacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaaataaagggcttagaccatgtagcaagtgtcacccctgcaatgcctaataaagaagggaactttgccatcattacggtcgttccggaaacaggtccaaatgatgtcacaacgaaagatttggtacacgatgtacgcagtttatcagataaaaacggagtagatttgcttgttactggatcgactgcagtgaatattgacatttcagatcgcctcaatgatgcgataccggtgtttgctgtacttattgtgggctttgcgtttgtattgctgaccatcgttttccgttcgctgcttgtgccgcttgttgctgttgcaggtttcatgttgacgatgacagccactcttgggatttgtgtatttgtcttgcaagacgggaatctcatcgactttttcaaaatacctgaaagagggccgatactcgcgttcctgccgattttatctattgggattctgttcgggttagccatggattatcaagtattcctcgtcagcagaatgcgtgaagaatatgtaaaaacaaagaatccagtacaagccattcaggctggattaaaacacagtggtcctgttgttacagcagccggcttgatcatgatcttcgtttttgcaggatttatctttgcaggcgaagcttctattaaagccaacggattagcactttcctttggtgtgctctttgatgcctttattgtaagaatgacactgattccaagtgtcatgaagctgatggggaatgcagcctggtatttgccgaaatggttagacaagatgattccgaacgtggatatagaagggcatcaactgacaaaggaaatacagccggaaatagatcatgaacaaaagaaacaaatcagtgtgtaatagaaaaagcagatcttttatgatctgcttttttgcttatggtagtatttagaagatgaagtcggcagttaaaaggagacacttatggcgccatcactcattttcgatatggatggaactttgtttcatattggcagaagctgcatcatactagcaggcatcccaggagaagtgacatgattttttgactttgcattcactacttgatgccaaggatcttgagaatccttcttgaaaataaaggattttacaactgatcatataagaaacctaaagaaacaagcacacaaaaccagctgcgggttttgtccaagaaaaatagagtccataagagggactctattttttgaaatgcccggctagaagcatattgcaggactttatgaatgcaaatcactatcttataagcccttaccgtgaaatgcctgtttctgcattgaaaaaacgcattacacgttcatttacgtaagcgggttgttccatcgataaaacatgtccggcatttttaatgacttccgcctcaatatcaggaacgaatgaagaggctcggtgcagggctgagtggggatcatagatgacttcatgttcaccaagtaataataggataggaactcttgctgaacgtaattcctcatcggtaaaaacatacggaaatccgtcggctctaggatttggatttcttgatccatcctgccacattacccctgcctgaaactgcttcacaaaaatcgggtgcagcacattctgatcattcatcatccaatttaagaatgtttcaactccatttgacgctgtaaggccaagagcgtatttgtagaaatcgtgatgaaatggcaaaaacgtttctgccggactcagtatagctgcgctttttactctctcaggcatacgtaaaaggaaattcatcgtatggagaccgccaagcgaaagtccgatcatgtgggacttttcgatccccagattgtcaaacacatcaagaagccaattggcgtaatccgttcttgtaccgcttacattctcaggaatactcttgtttttatcacctatgatatcaactgcataagttctgtatttgctgctccaatcggcgatgttgggataccacatcgtcgagctgaataatgctccgtggagtaatacaagcggcggggcatcctctgggccgcttgcaatcacatgtgtttgaccaaaacgagtagatatatagaatgatttgcaacggaccggccaaagactaaggctttcattataagtttgataatagcggataccgttgtcacttaattcgggaatactagatgaatggtttgacatacaaatgcccctcccaacattgtttaaatgaatgtgccgtttcgtgatggggaatctgattttgatataacagactttatttacaatataatacagttgttgttagacgtcaaatccaagatgaaaaggaaataaaacgattggaacagattattgaaaatcaatataatagaatattaacctcctttgtggagccgcttcattaaaaccgcaatccaaatgcatgaatcacaaaaatcacaacaggagggatcaagagggaaggcagcaaattcaatgttttgaacttcttgattccaagaatgcttagacctgaactgaggatgagtatgcctcccacaattgtgatttcattaataaggtctgtattgattgcgctctccattactttagcaaataaatagatggagccttgccaggcaaataatacaatggctgcagccgctattccaaaaccaaaagttgaagcgagcacaatggaggtgatcccatctaacatcccgtttgtcaggaggtatgtataatctccatgcaaagcggcttcaacagggcccaatattgacagcgaacctatacaaaataataagaccgcagtagataagccctctgctaaattacttttagaaaatttgttcaccagcttgttgaatcgtaattctaaattgatgatctggcctagcaaacctccaatggctaaactcacgatgaatagaatgggatatttactatcaggcaaatgctgtgtaatggcgttgatccccagcgcgactgcagcgaatcccattgcctgcatcaaaatatcctggtattcatctttaatgccttttttgaatatccccccgattatgcttcctgcaatgatcatcactgtgttaaaaatcgttccaaacataagttttctcctccaaaaatcattcctgcataaaaaataaaccctctagttagtagagagtcaagggagataaaaacatattcatgagattatttgatgggcagcaggatttcagtcacgtaattatctaggttattcgtaatgccataatcaatgagtgtgatttcgattgagtcccctgctacttcataatgatgttctttcatatatgccagtaattttttgtagtatggttcggcttctggatgtgaccctttaaacctaatttgcagatattctcttgaaggaaagatgatttctgaagaagttttttcattttcatcttcaagaatcataaatatactggaatatttgtcaaactgttttgctttcacatttgctgcagaaatggataaaccaatcttgcctatgaatatatcttcgtttacattcaggtgggttctcaattcagctaacgaatgttcgatatcatggccgagaacatattcatgctgcaagtaagccacacgcattgcgggaagtttgatttttgaaatttgatgtaacggcatgttaacggcatcttctatatgtgtgatgcgtcgggagatctttcgttcgatgcgttccaattctttcttttttcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatatctatagttcgtttgctcatctttatattccggtttcaaaaggccgatttcatcataataccgaagagcagagattttcacattgaataactttgacacttctccaatcgaaaaaaattccttcattctaacaacctttctgtgcctatgattgatatacacacattatatagtacggcgagttctaaaggtaaagtttgcatcataaagaaaaagctccttctaaaaaggagcttttcactcttcgaaataaggatttacatggatgagcacttcttctacatctgaaaactgtcttttgatttcatttcgaatttcgcgggcaatatcgtgtccctgcttaattgtcaaatcatgatccaaagataaacggacatcaagcaatttatagtggccatgttctcgcgcgcggattctatcaattcgttttacttgatcacattgaaaaataacagctttatattcctctatcagctcgggatcaacactcttttccatgagcacatcaacagacggcctgattaattccattgaaatcttaaaaatgaggtaagcaacgattgcactggcaatggcatcggcgtacaacagataggaccatccgcgggtgtttccgatgatagccaacaggacgccgataaaagcggcaagagaggcaacgatatcgcctttatgatcgtacgcaatcgctataatcgctttgctgttccatttttccccttgctttatagaataacgatataagatttccttagccacgtacgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaattccgatcactgccaagactgcaatcgaagcaacgacatctgccgcggaatgtattccgtctgcaaacacggcttcactatcgcctaccagcccaaaaaagacctttcctgccattaagatcagattggcgatcaatgcaatcaaagcaacttttctgcttatttgttctctttcacttgccattttttcctcctataaaactgcacaaaaaaataggagtgctctatatacgctctccgtatcctttcctgtgtaatcactttgtttatcataccaattcaatttcgagtgggtctatagcaacgttgtttcctgtttactaataaataaggtgacagaaaaaaagttggagctatgctaaaaaggtcatacagcaaacaaatgagttcttatgtaacaacagtgatgattcgctattaaaatgctgccgtcagtgaaaaatttccacctaattttcaaaaacctattgacatgagaagatctgtattttactattatctcatattcaagatattttaatttgagatatttggtcggaaagatcagcgatcaagcgcaactctaagtgttcaatcgttgtcagttcttttacacaatattcaatatgattttttataacataatatctcgaattcgagataaaagggagtgtagcgtaatggctgaatttactcatttagtcaatgaaagacgatctgcaagcaattttctttcaggtcatccaatcacaaaagaagatctcaatgagatgtttgaattggttgcattggcaccatcggcttttaatttgcagcatacaaaatatgtgacggttcttgaccaggacgtaaaggaaaagctgaagcaggccgcaaacggacaatataaagtggttagctcttctgcggttctcttggtattaggggataagcaggcatatcaacaagcggccgatatctatgaaggtttaaaggtattggggatattaaataagcaagagtatgaccacatggtgcaagacaccgtttcgttttatgaaaacaggggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaacatagacgaccaatttgaggttgtcatgatgattacgattggaaaagaaaaaacagagagcagaagaccgcgcggctaccggaagcctgtgaatgagtttgttgagtatatgtaaaaggagcggataaaaatggctaaaaaaacgatgggaattcatcatattacagcgattgtcggtcaccctcaagagaacacagatttttacgcaggagtgcttgggcttcgtttggtcaagcaaactgtcaattttgatgacccaggtacgtatcatctttattttgggaatgaaggcgggaagccgggaacaatcattaccttctttccgtgggccggagcccgccaaggcgtcattggagacggtcaagttggcgtgacttcgtatgtcgtgccgaaaggggctatggcattttgggaaaagagactagaaaagttcaacgttccctacaccaaaatcgagcgctttggggaacaatatgtagaatttgatgatcctcatggactgcacttagaaatcgtggaaagagaagaaggagaggctaatacgtggactttcggagaagtaacgcccgatgttgccattaaaggttttgggggtgcaaccctattatcagagcagcctgacaaaaccgctgaccttttagaaaacatcatggggctggagcgagtcggcaaagaaggagacttcgttcgttatcgttccgccggtgatatcggaaatgtgattgaccttaagttaacgcctattggccgcgggcaaatgggggccggaacggtgcatcacatcgcttggcgggctaacgatgatgaagatcagttagattggcaaagatatattgcttcccacggatatggtgtaactcctgttcgggatagaaactactttaatgccatttacttcagggaacacggggaaatcctgtttgaaatcgcaactgatcccccaggctttgcacatgatgaaacacaggaaacaatgggcgaaaaactgatgctgcctgtgcaatatgaaccgcatcgcacacaaattgaacaagggctgctgccgtttgaagtaagagagttagattgatttgacacataaaaaataaagaaacatatattcaattgatgattgctggatggtactgtcagcaaagaatcagataaaatcaaagatgaggagagatacaaatggaagatgcaggactgttgcttattcgtataatgattggtgtggtgtttttgttttatggcacacaaaaattattcggctggtttggcggatacgggattaaaggaaccggacaatggttcgaatcaattggggtgaaaccaggaaacgttgcggccgctctatcaggtcttggggagttagtaagcggaattctatttattttaggcgtattcctcccgcttggagctgctatcataacaatcatcatgttaggtgctatcgtaaaagtccatggagcgaaaggttttgcgaatggcgccggaggttttgaatataacctggtgctcattgcagtttccataggggttgcactcatcggttcaggagcttacgctttgcatttttaatacgaaagtatgtaagaacagttgctgcttgtcagtaactgttcttttattttcacattttcggcaagcttgcaggtactctgcaaagcaaaaaagcggatatcataaatataaatctgtatagtgaatgatacgtattgatgagcttggtcatgaaaaacagacctatttgaaggagtaaatggatgaaagagatgacaggattacattcattagtttctatagaaaactttatcaaacagcacaaattcagttttatttatatatcaaggcctggctgtacagtatgtcacgcagttctgccccagctcagaatagtattggatcagtttccaaacatcaaattggggcatatcaatgctgacgatgtagcagaggtcgccggcagattttcagttttcaccgttcctgtgcttcttttgttcattgatgggactgagtttctaagagaagcccgttttgttcattttgaacagcttgaacaaaagctgaaaagggtttatcgattatatgaaggcgaataaaggaataaggcaaaaaaagaactcaaatgagttctttttttattcttcactaggcgaagaagggttatcaacctgcccttgatcacttgtatcattatcacaacttgctgaaataataattgaatgagaaggagagtaatctcctaatgtgaaattcactccgtaatttttgctgttcgcagtatggctgttttgcaagttttgtccgatatctgtattggcgttttgtgtcattccatttatcgtgagatttgagatgttgatttgagatcgcatgcttcaaaaactcctttcactcagaagtagctgtcataaaggacgctggcagtctatttacttctatgatattgcgtttttatatcattgcatcaacataatggtaaaaataatagcgagtgaatgatcatcttttgaagatgatcaacctatcagcagaaataaagccgcctgataaagaggcggcagatcgttatatgtcatctatgaatttgatgtatcgtttttcgtttgcctgaaggataagatagtcgtttttaatgatgagtaggagcctatagcagcgtagccataaaaccagcccataaatacgccagaaaagaggctgtgtcgatggcttatgaaaacagaaatgacaaggcctgttattaaggcaactgacggtacaaaagttttggggattttcaataatattttgaggatttgggttatcaatatgatgattggaacagctatcacagcatcccaaaagttcgtgtgaataattggaaaagccatacggcacctcatgaagtgtttatttcttaatttttacgctaaaagcttggaaagcagctcttggatcgcatatgttacattttgggcttgattggcggagcttgtttggcttaaagcattggattcaaaaaccaaacctgtattactcccaccggaaccctctgttgttttagacacagagaacgggctgatggaaactgcaaatccgttattaaaaacgctgttcccggatatcaaatgaatataaactgggaatttcatcattcatctctcctctctgttatgactgtttatacaatatggtgtgtgagcagcagttgcttaaacaaaacggcaaaaactttcagtaagagacaagaacctgcaaaatgccacaagcgccttttgttaatgcagctttttagggacgttttttttattttttttgccaacttcatcaaaaatattctgattgccagactgggcttgtccgtccttatttatgaaatcggggtgaatgagttttttcagatccctgactgttaaaggcttggcgtcatcagttaattctattcctaattgcccgtttgcctctaatgtcgcaattttgacatcttgtatagccgtaacgccgtgaagccttagctgcatttcaagctggtcagctgtaagtctcatcttctttaagttttcgatatgaagctgtccgttttcaatgacgatttttgcttttccggttaacatcttttcaatggtgttcgatttcatttggatccattccataacgatgagtgtgcttgtgaaaattgccgctgcaattaatgttttgaagaggctgtactcgatgattggctgaacgataatagttccgatcgaaatcatgacaaccgtttgagtcgacgtcatttgtgcgattgatttccttcctgaaattctcagcaaaatgaccccggctacaatgagaacaagagattcccaagtgaaattcatgctaccacctgaccaatgatgaattagatttgtcatgggattggcttttcttccggccaatcgcaatttaatatatccgaaaggcagtcggttcattctgtcctgaaccgaacaatatttttggtatagatggatatattaagccaaacaatgatagcaacaggagttttttggccgaaacaatctgggaagcggggagcgccataacatgattgaacttgaagttgtcattagaacggttgccagctttggcttgctgttaatcgcagaacgaattttaggcaaacagacaatctctcaaatgacgatttttgattttattgcggcgatcacactaggggcgattgctgccggattagcttacaatacttcaataaaaccgcacaatatggccatttcgtttagtatttttgtgctaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattacgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacaaaggcttccgatagaacttattatggacggagaaatcattgagaataatttaaagcagaatcgtttgacggaatcctggcttttggaagaattgcgaaaaagagacataaaggtgaaagagaccgtgtacgcagtgctgctgggtaatggggatatttatgtggatcaatataaagaccatatatcagtccctatggataaggaatgaaggaacaatcaatcttaaagccccttattgaacgcaacggtttcaacttgtcttgggtacgaaatatgcagaagcccgtttaacagctgaatctgtaacaaatgagtttcagcggcttcgggaagctgaatgattcgctcaatttctccgtaataccgttcacgcagcacttccatttcggctggaaaaacaggcgtgatcgttcctttgatcagcagctgggttttagacagtaaacggatcgttaattcttcctcatacacaccgggcatttccacaatgataaaattatattcctcatcttgataaaagtcgtaaacaaacgtagaagcttcggaatcaaaaaaatgttccggggctttatatttgagcacatttgtccaaaagtcactttgtttatattcattcgtaatctcaagccactttcgaattttttcgaaatccatatgagattctccttaaatttgatttgaaatcggcgcagaagggtttccgatttggtcttggtcactaacgtctgaatcaatatttccagtgtttaaaagtgaagacgtaggcgaaagatcccctaaggaaaagtttgctccaaaatatttgctgttcgcagtatggctgttgtgcacagtcggaccgacatctatatttccgttttgcgtgacgccgttgatcttaatatttgcgatattaatttgatatggcatagacgaaacccctttaatctaaaattggcggtggtgcaatcggaggagcattaacgttggatgtatcagagttgccgatagatgtctggtcatttacatcaggatcgtttaagaagttttccattacggattctgtaggtgatgtatcaccgaaagaagagttggtcccttgagatttttgattgttggtagggctgttataagcagcttcgcctattgtaattgaaccattgcccgaaatactgttgatcttcaaataatataggttgattactgtagacggcatcccatcacacccttccatctttctgtacagtacattatgcgccgctgcacccaattgttccttgcatttacgggcaaaactctatctggccccggagtgatgctcaattatcagtgaatgaaaagccattgatataggaatcaatgaattgattcagttattcgaaatgcatgagaccttttaataaaggaagctggcaaacaggatcagtttgaaataattgacaatgaagctaatgccatgaaataatactcgtgagtaacattaatcgtgagtattatttttggggtggtcctagttgaaaagtaaaggacgtaaaggagtagaaagccgaaaacggttacttaaagctgccgctaatgaattttcggttcggggattccatgacgcgaaggtaagtgaaattgtgaaaaaagctgggttcacgcagccttcattttacctgtactttcaaagcaaagaagccatctttgccgagttaataaccgattttcactctcgagtcagaaagctgacagagtcacttcttctggaaaacggattaaacacggaggatgtgtcaaaacgggtactgctagctgtagagactgttttttaatttttggatgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgaatcatttttgttaaccggaatcaaagatccggcaagcctcgcagcagaggttgtgaatcttttaatttacgggatgcttccgaaagggaatgatgtaagatgatatctattatgatgaaagtcagtttggcagtttttatgcttgcgggaggcatcataaaggtaagccgcgttccctttcaagttgagcattggcggcattatcaatatccattatggtttctgactgttactggcattcttgaaatagccggggcacttgctatgacagcgggaatttggaatcggtatgcagcaattggagcaggtattctgtttgtcgttctcatggcgggagcaattcatgcgcatatgtttcgagcaagacaatctgtcatcatggcgataccagcgatgatttgtttgattgtttcaatcatgatcatcatggggagttacacgtaagcttttcactaatgtttaagaacaagcccatttgcaggaaatctccttttcttatcgaataatagaaagtccaggaattaactgaatcagtaaaatagagctccatttctgtgttattcgtccggcatcagctgggctttttttataaaggaggaatacaggatggcattcactttggaagacatgactgaggaagagttcgaagcctttcgcgggatgtccgtgcaaaattttgcgaaacaaaacataacgtcaggaacttggacggaaaaagaggcgtttgagaaatcggagcaggcatatgaaaacatgattccgaatgggcgagacagcagcaatcattatttttggaacatcacaaatgaccaaggagaaagaatgggctggctctggctgtatgctgatccattacatccgcaaaaggaagcgtttatctattcctttgggttgtatgaagcctttcgcggaaaaggacttgctcaattggcgcttcaaacgcttgatgaaagagcaagagagcttggtgcggaaaggctggctctacatgtatttgcacacaacgagacagccgtctatctttatcagaagatgggctatgccatgaccaatatacgtatgcggaaacagctatgctgaaaagccgcttacgttacccaaatacaacatgcctatctggaagcggtggcagggtactataagtcatcattagaaagattaaggtcatgggaggcttgaacatataaagaaaaaggacaacagctgttgtccttttcaatgccgcttgaactttctccctcagtcttttttgtcttgatgatccagctcttttattcgtttcgtaagctcattgaaagcctgatcaagctccttataccctttatcatttggcgtcataaaactgagctttcccagcacttcttgtctttctgtctcaagctttaaccgaagctcctcccgctcatttctttctgaaggagcgtcgtttaactgcttttcgatgccgttgtttgagatgacgagtttactgtttgttgttttttcgagaaagtatcggtcatgtgaaaccgccagcaatgtgccgctgtattgtgacagtgtttcttccagctgttcgcgtgacggcaggtcgagatggtttgtcggctcatctaaaatcagcacgtctttttcctccagaatataggccatcagcttgatctttacacgctcacccatactcatatgcttgatcggttcagtccattgggcggctgtaaaacctaagtgcctcatcagattttgaacgtgcccccttgctttgaatgtttcattcttaaataactcttccggtgtttgttctaaaggcaaatcaaacacctcctgcgttaaatagccgatgtttgcggacggcgacacccatacgcttcctcctgctgtttcctgtccaagaatgatattcagcaatgtcgtttttccgctgccattggggcctatgatcgcaaccttttcgccgtgctgaatcgtaaagtttgcgtttttaaagagagtcctttctccaaacgcttttgttacattctgaacttctaaaaaacgtttccctgttttgtgggttgtatcgattgaaaagcggactgtatattctggggtaacgggttccgcttttgctttttccagctctttttcaagccgcttctgtttggattttatctgggcatccgtacgcttcgcttttacccggtgatattctttaaacccttcctttttcgtcgattgagcatgggctttttccgaccaagaagcgagctcattcatttgtgcttcaatccgttcgaccattttttgctgcttttcatattcacgctgctgggtgagtcttttcttctcccggaacttcatatacccggagtaattccctttgaattcaatcagcgtctgatcctcaagcgaccatatttttgttgcggcttcgtctaaaaaatatcgatcgtgagaaacgagaatcacagtgccgctataatgtttcagctgttggatgagaaattgcaagcttttttcatcaaggtggtttgtcggttcatctaacagcagcagatctgcatcctctgatagtcctttcgccagccgcgctttcagtttttcaccgccgcttaactgatgaaaatcacgaagaggcacatgccatttctccagtaacttcttttcggcaggtgtctggtccgcaaaggaatacgccgcggtttcctgttcaaccaaagccagttttatatccttccgaaggatttgaccctgtgcaggggctaagtcattgtgaatgaggtgcagcagcgtagatttcccagcgccgttttttccgataatcccaatgatatctccttgctgaacactggcgtttacatgtttaaaaacagtttgatcctttacttcatagctaacgtttgttaatgttacgatctctttcatccatatccctcgctttaaagggagaataaaaaaatcctcccaaatgtgttggaaggattagccgtgcctgtgcatgatcaaataagctattttttataaatagcagtgtcgtatatatagaaaatgggcagactaatcctattttttgatttgaaatattgatttcaaacggtaaaaataagattagttaatcattgtccacccatcatcccttcttgttttgattacaaacactatagcatatcttcaaattcaaaagcaaaggtcattttcatcaaaaaaacccctgctctcatttttgaggcaggagtttcgagtgttattgatgcttcgcttttctcactttataaatcacaatcagcaaaataaaccaaaccggtgtgacaaataaggaaacacgagtgtcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaatcccccaaatgtagataaagcatacggttgaaatgcttgtgatcagggtgaatacgccttctggcatgatgtagtttaacgtaacacctattaaaatcacgatagccgaaaagaataaagcatttctaggcactttacgctgagtcagtttcgccattgactcaggcgcattgtgatctttcgccagggaatagaccatacggcttgtactgaatacagcgctgttgcatgctgaagcagcggatgtcaacacaacaaagttgataatacttgcagccccgacgatgccaacagcgacaaatacttgtacgaatgggctttcgctgggattgatgacatcccaaggatagatgctcataatcacgagaagagccccgatataaaaaagcagcacacggacagggatattgttgatcgccttagggattactttttcagggttttctgtttcaccggctgtaagcccgacaagctcaatgccgacaaaagcaaacacaaccatctggaacgagaggataaacccgtgcatgccattcgggaacaggcctccgtggctccagaggtttgtgaagctggacactcctgagcttgtggaaaagcctttgaaaatcatcacaaggccaatgacgattaacgccaaaatggcaatgactttaatcaaagcaaaccaaaattctaattctccaaaaagcttgactgtcgctaggttcataatcagtaaaataattagagcgattaagccaggcacccattgcggcacacccgggagccaatattgagtgtagagcccgactgctgtcagatcagccatcgcaatggaaatccagcagaaccaatatgtccagccggtgataaatgctgccatatcgcctaggtagtcttgtacaaaatccacaaaagagtgatagttcaagtttgataacagcagttcacccagcgatctcataattaaaaagcaaatgatccctgtgatcatataagcaaataaaatcgaaggtccggcaaaatgaatcgatttgcccgagccgagaaataagcctgtcccaatggctccgccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgcttttttatgctttttcagtttttttcataaacaggtagagcccttaatctgtcggtgcggatgcgtagcctgcctgccgcagcattgctgtgatattgccgcggtggtatgtcccgtgattgacaacgtggggaagcagttcggaaacagttgttttcatgattccgcttgagggattttgaatctggagtggcttattgagctgttctttttgctgtaaaaatagtatatagcgctcggataacctcagaaaaaggtcttccatttcctctatttctttagcctctgtctgttctttaagctgttcagctaaagccaaagcatcgctcaagtttttgccggaaaacacttcaatccagccgagatcagaaagataaacatgagacaatacatgggatattgacggaaacacgctttgaatttcttgatggtatacctcttttggaagctcttttaatcggttgaatatttgttgattggcccagacgttatattcatacaatttgaatgccaaatctgacatgttaaaattccccctttcgtgtgtatagcttccattatacacgaacgtgcgttcttatgtggagtgctcgtgaataaaatttgttgacatatatagtttaggggaataaactaattgacattgaacataaggtttagcggggtaaactataatgaggaggggaagatattgaatgaacaaaagctatgtcaggtgataaacctgtttgtggaagtcctgcttgaagggacagaatttgtgcatcgtgaaatcaatcaggatgtcttcaagcatatctcaagggaacaggcagacctgttgaaaattttaaaagtcaagggcccaacatctcccggcagcctggccatgtaccaaaatgtacataagagcgcgatctctaacagactgaaaaagctgctcgaaaagggattggttcaatggggcgattgtccggaaaaaagtgataggcgctctaagcttattaacattacacccagtggtgaacacatactagaagaattagattctgccatctttaacgcgctcaaaccgctgatcgatgatatagaggaggaacacttacattccatcatcgagatattcaccattttaaaaagcaaatttaaaggaggagattctgccgaatgagagcaatcatcaaattcaagtgggcaattgcagccatagtattagcacttaccgtcgttttgagtttgttttctccgaacttaacggagctggccaatcaaaaggggcaggcccagcttcccgctgatgctgtttcagaaagggcaaacgccattttaaaacaagcgggagaagacaataattcgatcagtgttgtctttacattagacaacgctttaaagaaagaaacagagaatcagctccggataatgatcgataaaatcaaaaagatcgacggtgtagaagaggtaacatctcctctgtcagcggagaaagaagtcaaagaccagttgatgtcgaaagacaagaaaaccgttctcatgcctgtcacgattacaggttctgataaaaaggcggaaaaaattgcggacgagatttatcaaatcgttcctgatgatttgacggcatatattacgggagcttcccttatcaaccaggatttcgctcacagctcagaggaagggcttaagaaaacggaagtgatcacagtttgcctgatcatcggtttactgttgatcgtgttccgatctgttgtgacgccttttatcccgattgtggttgtcagtttttcttatctgatcagtcaatccatactgggcatccttgtatacaatgttgattttccaatctcgacgtttacgcaaaccttcttagtcgcgatcctgttcggcattggaacagattactgcatactgcttcttacacgattccgtgaagaattggcaaacgggcatgataaaaaagaagcggcgcttatcgcttaccgcacagggggaaaaaccttatttatcagcggattcgcggtattaatcggattttccgccttaggatttgcgaagtttgcgattttccaatccgcagtaggggtagcagtcggtgtgggaattttaatgatcatcctctacacactgctgccattatttatggtgacgctgggtgaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagacaaagatcttacaacagctgatacaatcccctatctaggaaatatcagcaaagcgatcgagaaagttgatcatgttgactctgtgatgaccattacgcagccgactggtgaaaaaatcaaagatttatatattgataaccagctaggatcggtttcagacgggctggataagacggtaaaagggattgccgatgtccaaagcggattaacggatatagaaaacggactgaatcaaatggcagggcaaaccggctcggcctcaaatggagggtctggcggttcactgggcgatgcggcagatggcttgggcaaaatcaatcagcagctgcagctcgtgagcaaacagatttcccaaaccgacaataccgcacagaccgtgcagcagcttacggcaatcagcggacagcttggccagattcaaaccggtcttgaacaagcgaaccagcagctctcaggccagcaggcacaagccggaacgctgacagaaagcctgaagaagctgtccgaaggcgtgaggagcgcaaatcagggcctgacgaaagtctctgacggtattacagcttccagtgatatgttagaggacatgagcaaaagtccaactgtaagagatacaggcatattcattcctgatcaagtaatgaaggacaaagactttaagaagtcaattgaccagtattcctttgcagacggcaaaggtgttcaattaagtgtcgttctggattcaaatccgtactcagaacaagctattgcgacaataaaccaaatcaaaaaagctgtcgcaaacgaagttgacggcactcctttggaggatgcacagatcgtatacggcggggtcacgagtatgaatgcggacttaaaggagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaacggcttaggaaacgcgggtgtcagctgggcagtgccattcttcagctttgtcatcttgatcgcgttaggggtagattattcgatcttcttgctggatcgatttaaggaagaggtgcaccttggcattgagcaaggtgtcgtcaggtcaatgagcaaaatgggatctgtcattattacagctgccattatattggccggtacgttcgcggcgatgatgccttcaggtgtcaatacactgatgcaggtggcaagtgttatcatcatcgggctcttgctttacggccttgtcatacttccgctcttcatcccggcaatcattgcgacctttggagaaggaaactggtggccgttcggcaggaagaaaggaaaagagtaatcgagagaagagtgatgaatggtcatcactcttttttcatgactaaacaactaacttcagacgtgttacccaaaaaaggtcagacgatcaaacggcggctgtacttacaaacaaagagcccggaaaacattcccgggctctttgttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacaagacctccgtcaatcaggatcgtttcacggttgacctgtgccggaagcttttcaaaatgtgcggtcagcgcagcgatttgtctgtctttgacctcctgcggcatgtaaccaagttccacggcttttgaatagatttcttctaagtagtctgcattgttcatgtctgcaaatacagcgatgacagcagatgatgttgtgacctgtgtttggttaaagctggcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcgaatcgaacggcggcctttcataatttccataaaatcgtttgttttgatcatgttgatacactcctcttaagcttcgatattatttatattgtttcgcatgcgcgccagcacatcaatgagcaggcggcgttcttctgcgcttacatttgcgagcatttccttcatgaaacgctccttttccttcttagaagactcgattcgctctcttccttggtctgttaaccgaacaagggtgatgcggttgtcctcaggcttgcgccgccttgataccatgcctttggcttccagctgtttcaggtgtctggtaacggctgcgctatcgatatttactttcttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacacgtcaattaatatacaacgattgatttcatcttgcaagccatttgcactctagaaaaacctcccagcgtataaaattcgctaggctagaacttagcaaaaaaagttggccgcttcttcagatgatgctggtcacgatgattccctgcatcattcccatttataggtgttcggaatatcactttgccgagcccatgctcaagcggctttcacaggctgaaagttatgatacaatatacaaatgtttcacagcttcaatccatagttggagctgacatccattatataagggactaggttgaagggaaggtttgataacatgctgcacaatccaactggaaaagaacgcttggcactagcgtttctgctcggcatgcttgctatattgggcccgcttaatatagatatgtatttgccaagttttcctgaaatcgcggaagatttatcagcaagtgcttcacttgttcagttaagtttaacagcctgtctggtcgggcttacgatcggccagctgattgtcgggccggtcagcgatgcgcagggaagacgaaaaccgctattaatctgtatctttttatttgcgttatcttctctgttttgtgcactgtcgcccaatataacaactttagtggctgcgcgttttttacagggcttcactgcttctgcagggcttgtgctgtctcgcgcaatcgtccgcgatgtgtttaccggaagagagctttctaaatttttctcgctgttaatggttattaccgcggtggcgccaatggttgcgcctatgacaggcggtgccattttgcttttgccgttcgcaacgtggcatacaatttttcacgttctcatgatcatcggatttttactagttcttctgattgcattgaggttaaaagaaacgcttccgccggaaaaacggattccaagctcaatcggaacatccgtcaaaacgatgggcagcctgctgaaggatcggtcctttatggggtacgcgttaactgtcggatttattcacgggggaagctttgcatatgtgtctggtacgccttttgtataccaggatatctacggggtgtctccgcaggtatttagtattctttttggcattaacgggctggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatatccattttcatttacatgattacgatcggcatggttctgaccagcacgtttaccttggccatggaaaagcaggggcaccgcgccggaagtgcaagtgcgctgcttgggatgctcccgctgctcctcggttcaatcgtgtcaccgcttgtaggcattaatgagacaacagccgttccgatgggagccatcatgtttgtaacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggcaccgcacattgtcccgaccagaactttgacaagcaaaacgtaatcaacaaaaccttctgtgatatacccgatgcctccacctacagccagagggatgatcacaagcatcgtcgttccgacagaatggcgaatggacagattcagcataatcattaaaccaatttgaataaaaggtgccgacccaatgccgaatgtgccggaaagaacgccggctacaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagatgtcagcttggcgccgaaaaatgagccaaccgcagcaaagcctccgactattaagccgattttcatttgaatgtttccctcgcgatagtggctgtatgcccctgataagcttgtaaaagccatgccggcaagcgaagtgcctaaagccgtatgaatcgggatatggaaaagaagcgttaaaagggcaatgacaaagccggctccaccggcgccaataaagcctaaaataattcctagaagaaacataacaagaataatgagcatattttttcctccattgaaaagatgtaaaaatgtaatcgtgcgctattctggcggaggtatggtgtcctattgacaaagaaaaacacgccgttttttcagttgccagtagtccgtcgaccgtcgttcagcaaacatatcgtacctcaaattctgggatctgacaaggcagtttgttgcttcccattaccatctgttatatgattttgatgaagaaaagcccttgaatatattcaaaagaggtattatatatggacgattttaaattagataagccgactccctactacctgcaattttataaccagctaaaaaaaatgatcttcaacgggacttttaagcctggggaacggataaacgaaacacagctggcgaaaagctttggcgtcagccgctctccgataagggaagccatgcgattgcttgagaaagatggtttgttaaaagcggatgaccgaaatgggttttcgatcacgtcgttaacggcaaaagatgtagatgagatttataaaatcagaattccgctggagcagctggcagtcgaattagtcatagacgaagcggacgaagaagagctgaccatactcgaaaaacagcttgaagaaacagagaaagcgatttacaacggcacggaagatacggaaatcattcgtttaaaccaaaaatttcatgagctgctggttgatttcagccataacagacatttgaaaaatttgcttgagcatgtaaatgatctgattcatttttgcagaatccttaattataccggcgaccaccgtgcagaaacgatactgcgtgagcaccgcaggatatttgaagaagtgaaaaagaaaaacaaagaagcagccaaacagcatgtgctggcccatttcaatcatgactgtgagcatttgaagcatgtgcttgaagaaggaaaagagaattgatttgtatgatccggtaccaagggggagcagaacccttggtatttttttatgaattcaccacatatctaagagaccccgttaataagattttatgatggtttgactaacgaataatgggggttaaacatgtttatccatatcgtcgggcctggtgattctttgttttcgataggcagaagatacggtgcttctgttgatcaaatacggggtgtgaatggtttagatgaaacgaatatcgtgccggggcaggctctgcttatccctctttatgtatatacagtccagccgggagatacgcttaccgccattgcggcaaaagcatttgttcccttagagcggctgcgagccgccaatccgggcatcagcccaaatgctttacaagcgggagcaaaaataacgattccttcgatctcaaattacattgcgggaacgttaagtttttatgtgctccgaaacccagacctcgatcgagaattaatcaatgattatgcgccatactcgtcttcgatttcaattttcgaataccatattgcaccgaacggcgacattgcaaaccaattgaatgatgcggccgctattgagacaacttggcaaagacgagtcacgccgctggcaacaattacgaaccttacatcaggaggcttcagtacggagattgttcaccaagtgctaaacaatccgacagcgagaaccaatctggtcaacaacatttatgacttagtttccacaaggggatatggcggtgtcacaatcgattttgagcaggtgagcgccgcggatcgcgatcttttcactggatttttacgccagctgagagatcgacttcaggcgggagggtatgtgctgacgatagctgttcctgcaaaaacaagtgataatatcccatggctgaggggctacgattacggggggataggagcggttgtcaattatatgtttatcatggcttatgattggcatcatgccggaagtgagccgggtcctgtagcgccgattactgaaataaggagaaccattgagtttacgattgcgcaggtgccgagcagaaaaatcattatcggagtcccgctctacgggtacgactggatcataccgtaccagccgggcacagttgcttcagcgatttcaaatcaaaacgcaatcgaaagagcgatgaggtaccaagctccgatacaatattcagccgaatatcaatcaccgtttttccggtacagtgatcagcagggacggacgcatgaggtatggtttgaggatgtcagaagcatgagccggaagatgcagatcgtccgtgaatacagattgcaggctattggcgcttggcagttaacgctgggctttacgccgggcccatggcttctgcggaaattttttacgatcagaaaagtgtaaaaaaagacaccacagctggggtgtctttttttttgattaagtccagagcagcagaatagttcattcatttgtaccttgcatgggttgtgttcccattttacgattagtagtagtctgatcaaacaaagagtcagaatacgatttgagagggagttgtctacatgaagacagtattgattttgaattttcctgcggaaggccatgtgaatcctactttaggcattacaaaagcgttttccgataagggatatgatgtccattatatatccactgaaaaatataaaaaacgattagaagcagcgggagcaacggtccatcttcaccgggatctgctgcgaacgacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtgagggattacttagatattccaggggtctcttcatcggcgtctttcctgtttggcgaggagcacctgaaaatcctgccgctgcatccggagtctggagcgccgcttgaattggatcaagagtgcgaagatcttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctatttatcgggccgagctttccaaagagagcggaaaaaacagatttcccaattgaacagctaaaagatgagaaagtcatttatatttcaatggggactgtactggatcatacagaggatttcttcaacctttgtattgatgcattttcaggctttaacggaaaagtcgtcatcgctgccggagaaaaagcggatctgaccaaattaaagcaggcgccggaaaactttatcattgctccgtatgtccctcagctggaagtgctggagcaatcggatgttttcattacacacggcggaatgaacagcgtaaacgaaggcattcatttcagcgtgccactggttgtcatgcctcatgacaaggatcagccgatggtggcgcagcgtctctctgaactccatgcaggctatgtcatctctaaagatgaagtcaatgcccaaatattaaaacaggtcgtagatgaggttttgcgcaacgatcagtatacggcaggcattaaaaaaatcaatcaaagcttcaaggaatgtatggacatggaagaagtgatggagcggattgatgagttgattcgccaaaaaaacaaataagaaaaagaactcccgtaccttgtacgggagttcttcatttaaaacttgattttgattttttgagcatcactgattttcttatggttatggtcaaagacgtcacttgtcgtgatttcgatccacttaatctcttttgttttcatctcagcatccgcggccttatcatgagcatggccgcttgatgcgttcacaataaagccgagatttccagacttttcggccccgccttccaattcaccgtttaactcgtcaagataaatatctttgttccaatcaaaggtttcgcccgtatttgttttcatcaatgcaatcggcgcaacatttactttttttgaagaggtgttcttgatatcaacgaaaaccttaacgaaatcaaactcttcatcgtgtgttaactcatgaaagtaatcaatcatgctgtagtccgggcgcaagtggatcagcttcatttcttttactgttaactccacgtcgccaatcttataggttttgttcacttgtttgatatcttttaagacagcttttcctttatcatctgaaaacgtttggccgaccttaagcaatgaccggtcatcagttacctgggaattaggctgataatcatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtattcttttacttatcgttaatcttaatgttgtattgtaaagccttgaagacatttttggcgatttctgtattgtcgatttggccggcaaatgtctcactagacggaccgtatgcatagacgggcacatcttcaccggtatgtccgcctgtggtccatccagtgtgagagcgtttgttaaagatgttctcgattgcgttatcgatatccagtacttccttcgattttgccgcttcttcaacagattgaatttcggcttttgttaaagccaattttttttgatcgatatatgttttcaacgttttttcaacatccgcgccgtcagcgatcttttctgccataaagtctggtgtgcgctttgcggctttaatgggttcactgaaccaattgtagatgccgtccgcaccgatggaatatccgccggttgagtggtcagccgttgcgacaaccaatgtgtgcttgtcttttttagcgaaatcaatagccgccttataagcttgttcgaagtcttccatctcgctcatggcgccgacgatatcattgtcatggcccgcccagtcaatttggctgccttccaccatgaggaagaatccgtctttatccttgtttaatttttttatggctgtgtttgtcatgtctttaagtgatggaacatccttcgtccggtcaatctttttaggcaggccgccgtcagcgaataggccgagaacttggctgtctttgtttttcagcatgtccttgcggttatccacatagctgtatcccgcttttttgaattccttgatcaaattacggtccttacggtcaaaattgctctttcctccgcctagaaggacatcaattttgtgcttgccgttgaccatctcatcaaaataatcatccgcaattgagttcatattttttcggctgtggtcgtgggaaccgaaagaggccggagtggcgtgtgtaatttctgaagtggccacaagtcctgttgcttttcctttttctttcgcagcttcaagcaccgttttggcttctgatccgtcgttatccaccgctatggcattattgtatgttttaattcccgcagacatagccgttgccgccgctgcagaatccgttacattttgttcaggatcatcggggtaagttgtttgctggccgacaagatactgatcaaaagccgtaggctccacaacttttgtctttttattatcctttaagtatcgataagcagacgtataagacacacccataccatcaccaatcagaacaataacattcttaatttcgtcgtggttcccctttttcttttcctgggcgctggcttcaggcacactgccgctggctaagctgctgaacgcaattgatgataaaaccgcgataggcagtaatttcttcgggaattttttcaactggataacctcctaaatatagatgaatctcaatgacaacccaattatatttttaaactgttaagctagtattaatcgattttaaagattggatttacaagaataatgaactgctatcaaaagaaggaaagagtgatagtactaaagaaataaattggaggaatagatactggccgtggataggcggactgaaatctgctatagtcgcatagaagcaacccgcttacatcttgaacaattttaagtattatgttggaaggggtattgtgtaagcacatgtctgagcagttcatatggagtggcatcattttattttaggagggaacaacatggacgttttttctgagtatttagcggggattgatgacccgttccaccgagaaagaacggaagaggtgttaacttggataaaaaataaatatccaaatttacatacagaaataaaatggaaccaaccgatgtttacggatcacggtacatttattattggctttagtgtttctaaaaagcatttagctgtcgctcctgaaaaagtaacgatagcgcacgtagaggatgatattgtgaaggccggatatgattacaccgagcagctgatacgtatcccttggaacggtccagttgattacacgctacttgagaaaatgattgcgtttaatattctggacaaggcggaatgctccactttttggcggaaatgaaaaaagtagaaaaggcataacatatgagctgtataaaatatgctattccttttcatttgtctatttttcgttttgatcatctattgctgcttttcatcaaacaaggtcttttcattgagcgtaagctgactcgcagaataatgattaccttgtttccatttcacttcaatggttatatcatggccttcaagctcatgttcatctaaccgctctaaaaaagaaacggacttttcttttgcgcttccatcagaaaaagtgcctccagcataatcatgcatcgggatttccgtgtcagaactcagcagaatttcatcatccttttttacaatcagggattccaaataagtgttgtctatttcaattgtatcaccgatccaataaagtttgccgctgtattcattcggtgcatcttcattttttgtaaaaacagcttcccaattctgatctttgctttctccctgccaattcggatactccaaacgaacatgatgaatcaggtgataggaaaaaaagatcaagcagaaagcgattaataggaatgccgtgaaaatgagagggtatttataatgactggacataaaagactcctattcgtttaatcaattaccttcgaaaatagaatttcatcccgaatcaaaatgccgttttcagccacctcgggaatctccggcttgagtcggcgcgctttttcaactgcgttcggaaacacttcggcgaattgatagcctctcttttgataaaacgccatcgcatgtacattatcattcgttgtgataagctttattcgttgacaatgtgcatgtttagccgtctcttcaacctgctgaagtaaagctgtgccgattcctttattttcaatcatactatctaatgaaataatttcacaatctttcccatctattgtgaatgtaatacagccaatgatttcgccgctttcatttactgcggcaaatccatctaattcatcacagcgaaaaatgccgctggaaatcgccatctcgggtgtaccccattgcttggcaaaaaaatcggtcaacatatgtttcgctatctcattgtttgggatgatgatcatcataacactcctctattgaaagattgcatatgtactatcaatataaacaatatataacaaaaaaaatagatattgaggtgacggcatggaaatcagcgatgttatttacgggcaccaccatatagacggagtgctggaagagcttatcaaaagcgctcctgtgcaaagattaaaagggatctatcaaggcggagcaagctttttagtcaatcgaaggtggaatgtgaccaggtatgagcactccatcggcgtaatgctcctcatcaaaaagctcggaggaacgatagaagaacagattgcgggtctgctccacgacatatcacacacagctttttctcatgtggtcgacgttgtctttgaaaatcaagcagaagactatcatgaaaacatctttcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattagcctgcacgaagcgcaaacctttttggatcatcttattgtgagaaaaggaaggatgtttcctgatagtattgaagccgccgaatggtttgtcagtgtgtactacaaggaagtgattgatttctttttgaatcccgtgaatgtatatggatatgaatatttagcgcgagcattgaaggcagcgctgcggcatgatgtcatatccgcagaggatctcctgaaaacggaccaagaggtactgaacatcctgcgtgcatcaaaaaatgaagaagtcctgagcttgcttacatccattcatcccggcatacaagtaatagaggatgacatccagtacgatttccatcaaaagaagaaaatgcgcctaatcgatccatccatttttcttgatggcgaatggatcaaatcctcagatgcttctgaaaaggtgaggaaaatgggtgaggccgcttatcaaaaagcaaaaaaaggtgtgtatataaaaatcttaaatcagtaaatgccgcctgaaagcggccttttttcatgtttggctttgcaaacaaaggggaataggacaaactgcgggaacgctttatgagaatatcagcgtatttacataccattcgggggtatagtattatcgagagggcatgttttcattgtcttcgggcaaaagttacaggaaaaaaatgaagcaaaggagaatgaacatgaaaatctctaaaaatgcactgggaattctgatgttatctcttgttttagttttatcagcatgcggcaataacaacagtacgaaacaaagcacacatgacaatcattcagactcctcaacacatgaagagatggaccattctggatcagctgacgttccagagggattacaggaatctaaaaatccgaaatacaaagtaggcagccaggtaaccatcaatacttcccatatgaaaggcatgaaaggtgccgaagctacggtaacaggcgcctatgatacaacggcgtatgttgtttcttatactccgactaatgggggacagcgtgtggatcatcacaaatgggtgatccaagaagaaatcaaagatgctggagataaaacgttacagcccggagatcaggtgattttagaggcttctcatatgaaaggcatgaaaggagcaacagccgagatcgactcggcagaaaaaacaactgtatacatggttgactatacatcgacaacgagcggcgaaaaagtgaaaaaccacaaatgggtcacagaagatgagctttcagctaaataataaaaaatcctccttttacaaggaggatttttttgctgtttgaacaggtcttgttaaagaaatgaaagcaaacaggacagcgatgatcacaattgacccgccgcaccatgctgttgacactacagtacccgtctgatccaaaacaacaccgccaatggctgagccaagggcaattccgacttggagggccgacgtgttaaagctttgctgaatgtcagacgaatcaggtgcaatttcaattaaatagctttgctgagccggggcgaggctccagctcagaagaccccaaatcaccatgacaggcaaaaagaaaatcatagacgatgtagacagtggcagtaagaacataatgatggcaaaggaacccgtcaccagcaaaatgctcttaaaggaaccaagccggtcagatagcgctcctccgaaagggcctccgcatacagcagatatcccgaaaaggaaataacaaatgctgacccagaaagagctcaggtgaagagtctcttctaaaaacggtgcaaagtaagcgtaaagcgtgtagtggccagctaatgtaaacatcgtgacgaggtgtgaactcgcgattttcagattaccgatcgtcttgagctgttcccggaaaggaatcattttctccgccggtattctttcaaagaagattgaaataatcagcatggagatcagcgccaacaggccgatgccaaggaacaaaatccgccacccgaaggaatcgctgattaagattccgagcggcacgcctaatgcgatagcagagctgaaacccataaaaataattccgattgcgcgggctctgtattcaggcgctacaattttcggggcaattgttaaagaaagcacaacaatcagccctgtactcattgctgccaataccctagataccatcaatgtggcgaaattagggctgaaataggcgacaagattgctaaggaagaaaacaaataaagcaattagatataagcgcttccgctcaatcctcgcagtcaatgccaaaagcagcggcccagatactgcatatcccagcgcaaacacactgatcagctgtccggctgaaacaatggaaatgtctaaatcatttgcgatctgaggaagaatcccccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgataatagctatttaattgattcgtttccgttgatgagtgtaccacattatgaatgaatcttccatagaaaaatttacaaagtgatgaaccggacaagtgtatgattatatttattttataaaagtatagacatttaaaaataaatgactataataatcaatgtaagcgttttaatcacaaggggggatagcagttgaaaaaaatattactcgcgtgcagctcaggaatgtctaccagtttattggtgacaaaaatgaaggaatacgcacagtctatcggtgaggaagcagagatttgggctgttggccaggataaagcaaaagaagacatgagaaaagcggatgccgttttgatcggtccgcaaatgagctttctgaaaagcgaactccaaaaagaagcggatcaatacaacattcgggttgaagtcattgacatgatggcctacggaatggcagatgggaaaaaagcgtatgagcaggcattgtccttaatggagaatcaataatggaacaggtgaaaatcacgaacttaacagacgaacaaatcagttttcagcttatcctgcacagcggcaatgcccgcagctgcatcatacaatcactgcgcgcctacaaagaagggaacaaggatgaggcggatgccctcattgccaaggctgagcaggatttatccgcggcccatgacattcactttcaaatgatacagaaggaatccggcggagaagcacaagctttctcattgctgcttatgcatgcagaggatcatctgatgtcaacattatccatgaaagaattagtgaaagagatgcttgatctctttaaaaccaagaatctataaataatcggggtggatagggtgttcgagaaaatcagccaattccttgttccaattgcagggaggttaaacaataaccgctatttgcaagtgctgcgtgatgcatttatgctggctttcccgctgacgatattcgggtccatttttgtcgtgttaacgaatttgccgtttctaaacaaaatcatgaacgcctcaatgcttacatcgtttcagtctcatttcggcattgcctccacggcgacaatgggcattatgtctgtctttgttgtgttcgggataggctattacctgtcaaaaagctatcaggtcgaagctgtatttggcggagcgatcgctttggtttcctttttgctcttaacgccatttatcattcagtcagaaacaggagatgccattacaggggttatcccggtcgaccgtctcggtgcaaaagggatgtttcttgggatgattacggcatttctttctggagaaatctacagaagaatcgttcaaaaaaacctgacaatcaaaatgccagccggcgttccgcctgctgtagcaaaatcattcgccgcacttattccggcttttatcacattgaccgtatttttgctgattaacgtaatggtgactctgttttttaaaacaaatatgcacgacgtcatttatcacgcaattcaggctccgcttgtcggacttggaagcggtatcattccaacgcttattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcgattgtgtttaccattctcatattcatgaaaagcaggcagatgaagcaagtatcaaaacttggcctcgctcccggtatttttaacgtaaacgaaccgattatcttcgggcttccgattgtcatgaatccgatcattattgtgccttgggtgctggcaccgatggttgttacgctcgtcacctatctggctatgtcagcagggctcgttccgcctccgactggtgtgacagtgccgtggacggttccattattcattaatggtatcatggcgacgaactcaatcatggggggcgtgatgcagcttatcaatctgctgattgtcttcgtgatctggtttccgttcctaaaagcaatggataaattaaatctggcaaaagaaaaagaacaggctgtgcaggagacagctgctcagcaaaatgataacagcataaaaatgtgacataaggggagagagacttggcacaaacagaacaatatcgttttccaaaggatttttggtggggatcatccgcttcagcaacacaaacggagggtgccgccgacagagacggaaaaggccagaatatatgggattattggtttgaaaaagaaccgcatcgtttttttgatcatgtcggacccgcagacacatcccaattttacgacaactataaagaagatatcaggctgatgaaggagcttggccacaactcgttccggatgtcgatttcctggtcacgtttaataccaaacggaacgggcgagatcaacgataaagccgcaaatttctataacaatgtcattgatgagttgatcgctaacggaattgaaccatttgtcaatttgtttcatttcgatatgccgatggcgcttcaaaaaatcggcggctgggtcaacagagagacggttgacgcgtatgaaaactatgcgagaacgtgcttccgtttgtttggcggccgggtgaaaaaatggttcacgcataatgaaccaatcgttcccgtagaaggcggctacttatatgattttcattatccaaacaaggtcgactttaaagaggccgtccaagttggatttcatacgatgttatcaagtgcccgcgccattcaggcttacagggagatggagcaggacggaaaaatcggtatcatcttaaatttgaccccttcatacccgagaagcagccatccggcggatgtgaaagccggggaaatcgcagacgcgttttttaacagatcctttttagacccatctgtcaaaggcgaatttcccaaagagctggttgacattttgaagcatgaaggctttatgccagattacaacgctgaagatcttgacatcatcaaaaagaacacggttgacctgttgggagtgaattattaccagccgagacgtgtgaaagcgaaagaacatcttccgaatcccgacgctccttttttgcctgacaggtattttgatccctacgtcatgccgggccgcaaaatgaatccgcatcgtggctgggagatctatgaaaaaggcgtttatgatattttgattaatttaaaagaaaactacggcaacatcgagtgttttatctctgaaaacggtatgggggttgaaggtgaagagcgattcaggaatgaacaaggcatcattcaagatgattaccggattgaatttataaaagagcacctcaaatggattcaccgcgccatacaggaaggctcgaacgtaaaaggctatcacttatggacgttcatggacaactggtcttggacaaatgcctataaaaaccgatacggatttgtatcagtcaatcttgagaaagacggagaaagaaccgtcaaaaagagcggaaaatggttcaaaaaggttgctgagcaaagcggtttctagattttcctaaaggtcaagatcttccggcaatcatcataacgaatagagatgacgaaaatccgcaacattgatgaaatagggaaaagaacttatgatatccgtaaaagcttatgtgatatcaaactctaacagctgccggaggataccaatgaataaatacgaaatcattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgtttagaaaacgaggccatggcacgtttattattcaatctgcaatacaggatgaccatgtacatgtagtcagcaatgagattctcggattgaccaacttgctgaaagataaaaaaatccaaagcaaggtcattcagtttgaagtgcaatttcccactgaggaagtggccgcccatttgtctattgatcagaaaacaccggtttattatgtcgttcggctgcgaattgtagaaggtgaaccctatgtattagaaaaaacatatatgccgactcatttaataccgggcattaatgacgatgtccttcatgattcgatctacaatcatattacaaatgtgctgcagctcaaaatcgccggaacgcatcggaaaatcagagcctgcaaatctgatcatattgaccagcagcatctgggctgtaaacaggatgatccaattcttgaagtggaacatgtgggcttcttagataccgggattccatttgaatattccttttcacgtcatcggcatgacaagtttgttgtgacttctgtaaacatacggcgctgattgcggagacaacaaggaggccatctgcatgcttggcggtattgaagcaggcggcacaaagattgtttgtgctgtcggtagagaagatggaacgatcattgaccgaatagaattccctacaaagatgccggatgaaacgatagagaaagtgattcaatattttcgccaattttcattacaggcaatcggcatcggctcctttggccccgttgataacgataaaaccagtcaaacatacggtaccattatggccacgccgaaagcaggctggagacactacccctttttgcaaaccgttaagaacgaaatgaaaatcccagtaggatttagtacagatgtcaacgctgcggcgctgggtgaattccttttcggtgaagcgaggggtctcgacagctgcctgtatataacgattggtactggcatcggtgcgggcgcaattgtagggggcaggctccttcaggggctgtcgcacccagagatgggccatatttatatccggaggcacccggatgacgcataccaagggaagtgtccttatcatggagattgctttgaaggcttggcttccggtcccgccattgaagcgcgctggggaaaaaaagccgcggatttatcagatatagcacaagtctgggaactggaagggtactatattgcccaagcactggctcagtatattttgatccttgcacctaaaaaaatcattcttggcggcggcgtcatgcaacagaaacaagtgttttcttatatctatcaatatgtaccgaaaatcatgaacaactacttagatttttctgaattgtcagatgatataagtgattatattgtacctccacttttaggctctaacgccggaatcatcggcacgctagttttagcgcaccaggccttacaagcagaggcagcatccggggaggtgcgatcatgacgcatcctttatttttagagcctgtctttaaagaaagactatggggagggacgaagcttcgtgacgcttttggctacgcaataccctcacaaaaaacaggtgagtgctgggccgtttctgcccatgcccatggcccgtcggctgtaaagaacggcccgctggcaggaaagacactagatcaagtatggcaagatcatccagagattttcggttttccagataggaaggtgtttccgctgctggtaaagctgctggacgccaatatggatctctccgtgcaagtccatcctgatgatgattatgcaaaactgcatgaaaatggcgaccttggtaaaacggagtgctggtatatcattgattgcaaagatgacgccgaactgattttgggacatcacgcaagcacaaaggaggaattcaaacaacgaatagaaagcggtgattggaacgggctgctgaggcgaatcaaaatcaagcccggagatttcttttatgtgccaagcggtacactccatgctttatgtgagggaacctttgtccttgaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtaaaagaagttggtaacgctgagatcattgtttatgtgcaatcagattatttctcagtgtacaaatggaagattagcggccgagctgcttttccttcacatcaaacctatttgctggggagtgttctgagcggatcaggacgaatcataaataatggtattcagtatgaatgcaatgcaggctcacactttgtcttgcctgcgcattttggcgagttttcaatagaaggaacatgtgaattcatgatatctcatccttaatgaatgggggagttgcatttgtttaagaaacatacgatctctttgctcattttatttttacttgcgtctgctgttttagcaaaaccaattgaagcgcatactgtgtcgcctgtgaatcctaatgcccagcagacaacaaaagcagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttacggctgcgattatgccagagggtggcttgaaacagctaaaattgaagattcaatagatgtaagctgcaacggtgatttaatttcgtattggaaaaatggcggaattccgcaaattagtttgcacctggcgaaccctgcttttcagtcagggcattttaaaacaccgattacaaacgatcagtataaaaaaatactagattcttcaacagcagaaggaaagcggctaaatgccatgctcagcaaaattgctgacggacttcaagagctggagaaccaaggtgtgcctgttctgttcaggccgctgcatgaaatgaacggtgaatggttttggtggggacttacatcatataaccaaaaggataatgaaagaatctctctatataaacagctctacatgaaaatctatcattatatgaccgacacaagaggacttgatcatttgatttgggtttactcacccgacgccaaccgagattttaaaactgatttttacccgggagcgtcttacgtggatattgtcggattagatgcgtattttcaagatgcctactcgatcaatggatacgatcagctaacagcgcttaataaaccatttgcttttacagaagtcggcccgcaaacagcaaacggcagcttcgattacagcctgttcatcaatgcaataaaacaaaaatatcctaaaaccatttactttctggcatggaatgatgaatggagcccagcagtaaacaagggtgcttcagctttatatcatgacagctggacactcaataagggagaaatatggaatggcgattctttaacgccaatcgttgaatgaatcagtaatgtacaataagaaggtgctcaagaagtttcttgagtaccttcccactggattaagcattcatatcgcctaacccaggactgtgttcattcggtatttcaggaagcactggtacgggaaaccctgccggaggatctattacttgtaactctccgccatttcggcttggagatttcccttgatagatttcaccgattctcgtttcatccaatctaaagttaaactgtgcattatggtagcctaattcgacatactttctgcactcaggatatttattaatatcataatttggaacagggagcagcttcgcccattcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcaggttatccagcaggtcagtaattaagtttccgtggttatacacccacgacccgttccacggattgccccctgcatcaacgggaagggaactttgcgcaccaataatataatgatgaggattagcatgtttaacggcttcattaagtggtgcttgatctgcaccttgactgccgacaccttcaccgcctgattcatctaataaagcattgattgtgttttgaaccagttcaacgtgggcaatctcctctaaaaaaatgccgcgaagcagatcgcggtactgtttctgctttcctctgaaattagagctttggaaaaaaactgcatcattgtacgcatttctccgtaatgaccgcctaatatctcctgcaggaccttagcagctgccgggtctggtttgtccggtttaatgatattaatcagttcctctttgtagtaatacataacacgcctcatttcttcttaagagattttcttatattatttgtaagatgagataaaatatatacatgagaaggggggaaagaagagaataaaaaaatacagaaaaagtgttgaccaaataaaacaggcatggtatattattaaacgtcgctgatgaacagcgtgaaacaaaacgaaaaacaaaaaagtttttctaaggtgtttacaagattttaaaaatgtgtataataagaaaagtcgaattgaaaaagattcgaaaaaacattttaaaaaacttcttgacttcaccatcaaatgatagtatgatagttaagtcgcttgataagcgcccgtagctcaattggatagagcgtttgactacggatcaaaaggttaggggttcgactcctctcgggcgcgccaatataagatactacgcgggtgtagtttagtggtaaaacctcagccttccaagctgatgtcgtgagttcgattctcatcacccgctccattattgaatgatctttgaaaactaaacaagacaaaacgtacctgttaattcatttttaaaaatcgcacagcgatgttcgtagtcagtcaaactagggcctgcacgacgcaggtcacacagctgtcaccgcgggatggggcttttttgtattagataagaacttaggttactaagtgcgaggtgaaaaagatgagcaaagaaataaatacaaaagagcttgatgaggaactaaaaagagtgcttaaaatgtttgatgatgtattagaggtttatgaacagcatgacggcgaaccagatattaagcctggtataacttgcccatcatgcctaaaaaaatcgactaattatgtttgtaactggaacggaaacaaacatgtgcactttatttgcgagtgcggctgtcgagtacatcaataaaagtatagtgcccaatacgaagaactattcactgattattttttggaggaactaccatgtcaaacgtaagaaatcaaccctgctcttgtggcagtggaattaagtataaaaagtgttgtttggagcaccaaaataaatacactgttttttgtgatgaaacgggtaacagtggaagcaactatttagacttaaaccaacctttttttgtgattgctggatggattgtgcctaataaaaatttaaaaaacacaagctatatcgaagagtgtacaacatcgctgggcgtatctaatgaattaaaaagctctaaacttataaaaagaaagaaagcacgacagaaattcatagatctcttcgatagtctttgtattaatctggaatgcattcctacttttgtttttgcagagaaaaagtattgtgtagctgcaaagattatcgaaacacttcttgatccggcatataataatgaagttgattatagtttcacatttgacaaccttaagaaaaaagaattaactgaaaaagtttattcattccctaatgagtcattggaggattttataaacttttacttagatggtaacgcagaaaagatgacacagtgtatccgtcagatgtcagaccatgcgtactctataggattatatgaaataagcaaattatttaaaggggctttatcaggtatagtaaacaacttggaaactgagaaagcggcacatgcaagtatgcccaataaagcaatggaggctataaacgtaccagtatttctgtctataactcagataatcgaaaaaatagggaggaaaacaaagtataatttttcgcttgttcatgatgaaacaaagcaatttgaggatgcgtatactgatatatttaaaaaattttctgaagctgattcctttgaagcaaaactaactgatggcaattcaataattatgggatataaacatctaaaagacttttcttttattacctcgtcacaaagtaagtgggttcaagcagcagatattttagcaggtgtatcggggcgtttgcttaatgatataaaagatgacacactaaatgacgatagcttattaaagttagcaaaaacattgcttacctcattattgttccaagatgttattaaacttagtgactctatttgttctaatcaaactagagagaaaatatttgaagcaatcaaacccttagagaactaattttaaaacgaatctagaatcgttaaaggatatgttctttattctcagactttcgactacaccaataaaaaaatatttgaaaagctctatccagttaaggatagagctttatttattcctgaattgctgttaactcaccattttcgaaatacaaatatctgcttgtactgtaaacccattgttcagtagttccataagaagtcgttgttttattgacatccttcggttttccccatttattaaggttaagaacgtcttgtttagacataccaattgcaataggtgtttcagaactattctcctcgttgaacgaagcatcggcactttcattgtatgttacttctcttgattcaaatgtatttgttttgggatcatcatttttatatgtgtacaccattagcgtattttcctctggattgttcaatgggtcatattgaattgaatagctggcaaccttatcatttttgtttgggaggattaaaatctgttttattgagcaaatcttatctttcccacagttaatcttatttaggtttgagtttctttgagcaatctccattgctttacctatggtaagcaatttttcttcatcagataatgacgtgaaagatggtttagctgataagtttaaatcaaattgttggtcatttgatttatcagtttgtttcatccatacattatcaaaattttttctgacttccttatcattgcttacaatttcagcaatcttatctaacttacttgtgtctaacctgtttatgtacatagggattactataactaaaccaataacaataagtagagacacaagcccaataattctctctttagtcatatagatgtcctcttctcataagtttatcttacataccaacaaagggtcattctggtatttcttcaatttatactctccatatttattatataacagaattgaaattaataagtgccttcactaattattatcgtatgacatgggcaaatgtttaaaagaggggagagcatggaataagtgttattcttaaattcttgtaatgagaagtaatgaaaagaattgaataaattcctttccatgagagcagattaacaatcgaaaacttaggaaaggagtttgtgttatgtcagaaataaaaggattaggctttattccatctcctgaagatagacgtgatatccttatgtcaacgattttgccggtgttttctgctcctcgtaaagttgattatacggaacaaatgactgctgttagggatcaaggagaggaaggaacttgtgttggatttgcttgtgcagttggattaaaggagtaccaagaaaaaaaagaacgcacaattaacgttggcctttcaccaagatttttatatcaaaagtgtaaagagagggatggaattcctgatcaagaaggtacttatattaagactgcattagaagttttaatagaacttggagtttgtgaagaaacttattggccttatgtagcacataatacaggttcgccgaaacctggggcagaagaaaatgcaagtcgctataaaattaaagcgtacgcacgattggattctttagagacaatgaaaagaagtctagtagtcaacggtccatgtgttgctggtgttgccgtatataataattggagtacacaagaagtctggtcttccggaaaaataccaatgccgggaaattctcctttgaggggaggacatgcgatctgcatcgtcggttatgatgatgaaacggaaatgttcaaattcaaaaattcttggaacacaggatggggagacaaaggatacggctatttaccttacgaatacatggaattagctgactcagaagcttggagtgcaactgatcttattggagatcctgcttctttagtcagagcaaaagaaaaagcactcgagatcttagaaatggactataaaggtgaaacaagggactttaagggcagcgatcaaactgtagaatatcattaaaaactaagtgagctgactcaattatgcaggttgttaatgaaaatgaaaatgggaaagtggtcattcttaaggttgaagaaactttagaaattaatttgaccgaaaatgcatcaactggatatacctgggtagaagagtttacacataataatcaaatcttatctttagataaggaagaatttgttcaaaattctaatacgcatgggggaaacacaatacaccgatggcgttttaaaggggaaaaaactggtcaaaaaaaaataagatttatatatcagcgcccctgggtgaaagatcagcacggagataaagagtttgaaataactgttcatgtttcagattagtgtttagttaaccatctgttcttgcgaaaaattaaatcattttagggcagatggtttaatttgtttaacctaaatgtctttcagcaatcatgagggagggctaacagtgagtttagataaaggttttgaggtaacatttctgggtcaagactaaccctataccgttcccggttttagaagagggaactcaaagaactgcattaaatgaaggagagttttttccgtttacacacttctccattgttatgaataaagagcggaaatttgctatatattgtgctcataatattgacttaaataagagaaggaaaatcgagaggcatgatcgttggcattatgattctcgaattggagaagaaaaccaagtggggaattggctgtataaaggtggtaatcaggatatgtgggatagaggccatatggttactagagatgatgtgggctggggtgaagaggaagatcaagaaaataaagaggctgtagatgcagactttgactcattttgctgggccaatattgtaccacagcataaaatatttcatgcgagtgactggggtaaattggaaaggtggattgttgagcgaaccggtagtagaaataaaaagctatctgtttttactggtcccatctacacgaaagatgacagagagtattgtggttataggaagccgttaggttgtggggtcaaaatacctgcaggtttttggaaagtagtattttacattggcgatgataataaattacattcagcagcttttataatgatgcaagatgactattggaagcatgaaattagagaagaactccgtacactggataagtatagaattttagagaactttaatgttttagagaaatttcaagtccctttaaaaacaatcagtgaagttactggaatcatatttaaagaacaactttacaatacgaatcctttatatttttgggcaaatactgttacggagagaaaaaatattatgacccctgaagtttacaccatccaccaggcctcagacttattattagaaagagatctaatttagtgaagctatgctaaattgatttttaaaagtccgctcaagtgctaagccggtaccatttttggatatgattataaatggcgatacaatgggggcagggtataacctgccttttttgttacagtgtaatttaaataaaagaagaattttatttaaaagttatctatctagtggttaaaaagtccatgaaataataaaattatatgttttttagaagggaatatctgtcttgtgtcgaataggaagattagtcctgttagttaaattaaaaagaggtgttcgatatgacaaccaagctatctattcccttaaatgaatctggtaaaagaacaattgtacaagccccaaaagttcaaaagggtagtgagaccagatcgggagaaagatctactgtttctgcaccacggcctcaaaagtaatatttaattcattcactactagtcctgatttggaatcgacatatgtttttttaacaggataattgtaagtttgatatgcttgtttccattcatcaggctcttgtaggattaaagcacgttccgcctcaaaagggcgggacatattcgatacagcgccgtacattttgttgtctgggttattcaaataataaatttcgacaacgagaggaggcgtttcttcttttttctttttttcatcttttcttttaatttttttgtctacatcaaaagcaaggaaaaaggtatcccaaatagatgtagtttcatttagaggaacaatatttctaaacaatctaattttgttaattagtgataaaaaaacaccgtataaaaaaacagcccaaattgccgaaacaagtaaacttgagaataatgttataattgtgaaaaaagttaaaaagtgtatatcctcagcattacttttaatatctcctactgtcttcatataagaccaccaatgaaaatgactagaaataatattcatgatcaacacgtttatcaacgaaacaggtatccataataaagcagatagtccaacaagctcaccagcgttatgtttaactgctgggtttatacccaaaatttgaatccaaaaatatgctagtaaaccaggtaaagaaaatacaagtactgagattaattgctccatttattttaccctctcctaattgttaatttagtttattataacccatattaggaggggcttctttatatttccattataaaatcaaaaaaggacgcacccataaaatacgtccagtttattcaatatatttataagcctcccagatatatttgacgtttaatttatttcctctgaagttatcatctgagcctgtaaccattccttcatcagttaagctgccatatcttaaatcaccgcctacaagagagacccctttttcattaagttgataagtataaccccctgtatcatcaatcaatagcattgaatcatcagaagccactggccatatcttcacatgtgttggcataaaaggcaatactatttgtttactaattgttccatctcctatatatgttccttttgccatttgaggaatatcggctgatagggcatagtcagaagctactcgtccacctaacatctctgcatttccatctattgagccactaatgactcctgattgatcgcgtactggtatagagtttggagaagtcgttgttgaagctgtaaaaccattcaaagagtctgctgaaccagcagatgaaacaatccattcctctccgttaaacagttcctgtttattagtctttgggtcaatccaattgtccctgtctctggatcttctggcttggactctgttgatattgtatagagaccattaacttttccgctaaggcttccttttacttcaacagaaggagaagggaggtaggggttttcagacttaatgtttgaaaaaataatatctgatttaatgtatcaatcagtagcgatgttggggtcaacacttctatacgcttgtacaccaaatgtataatattttttaggggataagcaataccttgcatgtacttttcaggatcgattgtttttccattttgctcaatttgtaggtgaagatggttcccagttgagttccctgtgctaccaactttactaatagtttgaccggctttaactgattgacaaatctgattggtctgaaaaaaagtatgttcgtaaaacagacggaaaagttacaaagagtaagcaatacagatactcatgtcataatgcgaaaaacactcctcatcctaaaaggcactatggagcaaagctatatgaaaagcaatttgaggaatgtgttatagattttatgtctaacttagattttaaccaattcaagaaggaagcggataattttaagcataagcacattgacgaaaagcaagaaaagataaatcgaattgaaaaggaaatagacaaaaagcaaatacagttagataaactaaatgatgaagtggccaaatccttaatgggagaaagtaaatttacacctgaacaattaagtggagcaatcagcaaaacagagaatgacattgaggaactaaaaggaagtataaaattaatcaagaaggatatgtccggctcgcttgctaagatgtcagatattgaagagtttaaaaaagataatgagaactggattgatcgctacaagcaagctgacattgatgcaaagaaaatgatgatatccaaactggtgaaaaatgtgatctttaaggatggagagctacaaattgatttccactatactgtagagaaatcaatgataatttcaaggtggttaaataccccttttccgactgctacaggcggtccgggatacacaatcaaatgtgaaacagaaggcaacccgcatacaaatgaggcgggcgcactttctatggcacatgccggaaaagacactggcggcagccaatttttcattgttcatgagtcacagcctcatttgaacggtgttcacactgtatttggtaaagtaacaagcggattagaattcgcgaaaaacatgtctaatggcgacgtcatgaaagaagttcgtgtagaaggctaatcggcaggcaaaaggcttcctcttagagaggaagctttttttattggccaaaaatgttcaataaaaaaccgccgaatgctgatggcggttggcaaaaccaggtgtttaattagtgacccccgtgtattgaatacattaaaaagttttggtgacgttctgatcagtaaattgatgattaatcattttagccttgcttacaaagttattttcaaagacaattcctgtgtttaaacctccggagccaaacacagatttggacaaagttaaaggcctgatcataaaagcgccgcctacgttaattacgctgttcccggaaacgttgtttatattaataggataatcaatcatactatcaagtctcctttcatatcattctattttttatatgtattagtgctagagttgattagcgtaaacttaatggcaaaaatatttaggagatgcctgttcattggtattttgtggtaaaataaatcaaataaacgtgatgtaatgaaaaggagatcgcgatatggacaacaaaggctgtagaaaatgcggcagtactgaagccggacaaaaagaaatagccacaaccggcacgggattatcaaagctgtttgacgtgcagcataaccgatttctagtggtttactgtaagaactgcggatattcagagttttataataaagagtcttcaactgccgggaatatattggatttattttttggaggctgatccatgctttcgagcttgaatgattttaaacatatcatgaaagcaaaaacgggatgcggttacacctgtgaaataggttgccgcaaacattccagtaaccttcatgacgtgaattgttttgtcaaatgccatgggtatcatggactgggacatcaatggaatgcagtaaatgaacaaactgttcctaacctcatgccttatatacgatctaaagatttagcatatgagaactctctttcttctgagtccatcgcttctgaattatgcgatcatttctttcaatatttgcaggcttagttatgatcgacaagaaaaaataggcatgatgtgggtagaagatgaagattaacagtttgtaaaatcacttcaatggtcctaatgggattttttttcgattcgtgataacataaattgaagaccgttgtttattggaggaaatcagttgaaatcagaaaatgtttcgaagaaaaaatcaatattagaatgggcaaaagcaattgtgattgctgtcgttcttgctttgctcatccgcaactttatttttgcgccgtatgtcgttgacggtgaatccatggaacctacacttcacgatcgtgaaagggtctttgtcaatatgacagtcaaatacatcggcgagtttgatagaggggacattgtcgtgttaaatggagatgatgttcactatgtcaaacgtattattggccttcccggcgatacggttgagatgaaaaatgaccagctctatatcaacgggaaaaaggtggacgaaccttatttggcagctaataaaaagatagcgaaacaggacggtaaacctttgaccgatgatttcggcccggttaaagtgcctgataacaagtattttgtgatgggtgacaaccgtcggaattccatggacagccgtaacggacttggcctcttcacgaaaaaacaaattgcgggtacgtcaaagtttgttttctacccgtttaatgaaatgcgcaaaacaaattaggatcaagcagtttcccattggggctgctttttttatatcttttttacggtcatcccctaaaaacagaacataaattcgtatatctatagaaaagaaatttttgcagaaatgtgaaacatattcccgttatgcatcgttatattaataatttacgagaatttacggttttttattcatgaaaaaaaggaataactcatatgaatgaatagattcatattggctggaggtttagaaatgggaagaataaaaaccaagattaccattctgttagtgcttttgcttttacttgcaggcggttatatgtacataaatgatgttgagctgaaggatgttccgacagcaattggacaaaccttgtcctcggaagaagaggaatacaccatccaggaatataaagtgacgaaaattgacggctcagagtatcatggagtagcagaaaacggaacgaaaatcatcttcaacggaaaaaaattaaatcaggatttatctgatataaaagaaggtgacaagattaaggcatacttcagcaaatcaaagcggatcgacggattaatcaaggttgcaaaagtgaatgattaacaaaacatcacctttcggatcgaagggtgatgttttgtttttctcaaattgtaagtttatttcattgcgtactttaaaaaggatcgctataatagccaataaggacaaatgaataaagattgtatccttcggggcagggtggaaatcccgaccggcggtagtaaagcacatttgctttagagcccgtgacccgtgtgcataagcacgcggtggattcagtttaagctgaagccgacagtgaaagtctggatgggagaaggatgatgaaccgctatgcaaatggttcaaaaatgcatagtgttatttcctattgcgtaaaatacctaaagccccgaattttttataaattcggggcttttttgacggtaaataacaaaagaggggagggaaacaaatggaagagtattatatgaagctggcattagatcttgcgaagcagggcgaaggacagaccgaatccaatccgctcgtcggcgctgttgtcgtaaaggacggacaaattgtcggaatgggcgcccatttaaaatatggtgaagctcatgcagaagttcatgccatccatatggcaggagcacatgcagagggtgccgacatttacgttacacttgaaccgtgcagccattacggaaaaacaccgccatgtgcagaattgattatcaactctggcatcaaaagagtgttcgtagcgatgagagatcctaatccgcttgtggctggaagagggatcagcatgatgaaagaagccggcattgaggtaagggaaggcatcctggcagaccaggcggagaggctgaatgaaaaatttctgcactttatgaggacaggccttccgtacgtcacgctaaaagcggctgccagccttgacggcaagatagctaccagcaagggtgacagcaaatggatcacgtcagaggctgcaagacaggatgctcagcaatacaggaaaacacaccaaagcattttagtcggagttggcacagtgaaagccgacaatccgaggttaacctgcagactgccgaatgtaacaaaacagccggttcgggtcatacttgataccgtactttcgatttctgaggacgctaaagtgatttgcgatcaaatagcgccgacatggatttttacgacggcacgcgcagacgaggaaaagaaaaaacggctttcagctttcggagtgaacatatttacacttgaaaccgagcgcattcaaattcccgatgttttgaagatcctagcggaagaaggcatcatgtcggtgtatgtggaaggcggttcagctgttcacggaagctttgtcaaagaaggctgttttcaagaaatcatcttctattttgcccctaaactaatcggaggaacgcatgctcccagcttaatctccggtgaaggttttcaatcaatgaaagatgtccccttattacaattcactgatataacccaaatcggccgtgatatcaaactgacggcaaaaccgacaaaggaataggatggtgaccatgtttacaggaattatcgaagaaacaggcacaatcgaatccatgaaaaaagcagggcattcaatggccttaactattaaatgctcaaagattttagaggatgttcatcttggcgacagcattgcagtgaacggcatttgtctgactgtcactgattttacaaaaaatcaattcacagtggatgttatgcctgaaacagtcaaagctacgtcactgaatgatttaacaaaaggaagcaaagtaaatctggaaagagcaatggcggcaaacggccgtttcggaggccatttcgtctcaggccatgtcgacggaactgcggaaatcacacgaattgaagagaaaagcaacgcagtttactatgatttaaaaatggacccgtcattaacaaaaacattggttttaaagggatcaattactgtggatggcgtgagcttaaccatattcggcctgacagaagacacagtgacgatttccttaataccgcatacgatcagcgaaacgatcttttcagaaaaaacgatcggctctaaagtgaatatcgaatgcgatatgatcggaaaatatatgtatcgatttttgcataaagccaatgaaaataagacccaacaaaccattacaaaagccttcttaagcgaaaacggcttttagagaggaagatttgcatgtttcatccgatagaagaagcactggacgctttaaaaaaaggcgaagtcatcatcgttgtagatgatgaagacagagaaaatgaaggagactttgtggctcttgccgagcatgcaacgccggaagtcattaactttatggcgacacatgggagaggactgatctgcacgccgctcagtgaggaaatcgcagacaggcttgatcttcaccctatggtggagcataatacagattctcaccatactgcatttaccgtaagcatagaccatcgtgaaacgaaaacaggtatcagcgctcaagaaagatcttttaccgttcaagcattgctggacagcacatccgtgccatctgattttcagcgtccggggcacatttttccgctgattgcgaaaaaaggaggtgtcctgaaaagagcgggccatacagaagctgctgttgatcttgctgaagcctgcggatctccaggagccggcgtcatttgtgaaattatgaatgaagacggaacgatggcgagagtgcctgagctcattgaaattgcgaaaaagcatcaattaaaaatgatcaccattaaggatttgattcaataccgttacaatctgacaacacttgtcgagcgtgaagttgacattacgctgcctactgattttgggacatttaaggtttatggatacacaaatgaggtagatggaaaagagcatgtcgcatttgtgatgggagaggtgccgttcggagaagaaccggtattggtccgggtacattcagaatgtctcacaggtgacgtgtttggctctcatcgctgtgactgcggaccgcagctgcacgctgcgctgaaccaaattgccgcagaaggccgtggagtgcttctgtacttgcgccaagaaggacgaggcatcggtttaatcaataaattaaaagcttataagcttcaggaacaaggctatgacaccgtagaagccaatgaggcgcttggattcttgccggatcttcgcaactatggcatcggagcacaaattttacgcgacctcggtgtccggaatatgaagcttttgacgaataatccgcgaaaaatcgcaggccttgaaggctacggactcagtatttcagaaagagtgccgcttcaaatggaggcgaaagaacacaataaaaaatatttgcaaaccaaaatgaacaagctaggtcatttacttcatttctaatcacaaatatcacaaaaaaggatgggaatcatatgaatatcatacaaggaaatttagttggtacaggtcttaaaatcggaatcgtagtaggaagatttaatgattttattacgagcaagctgctgagcggagcagaagatgcgctgctcagacatggcgtagacacaaatgacattgatgtggcttgggttccaggcgcatttgaaataccgtttgctgcgaaaaaaatggcggaaacaaaaaaatatgatgctattatcacattgggcactgtcatcagaggcgctacgacgcattacgattatgtctgcaatgaagctgcaaaaggcatcgcgcaagcagcaaacactactggtgtacctgtcatctttggaattgtaacaactgaaaacatcgaacaggccatcgagcgtgccggcacaaaagcgggcaacaaaggtgtagattgtgctgtttctgccattgaaatggcaaatttaaaccgctcatttgaataatttgctgaaaacagtttaaaaatatggcgaaaatgatataatgtgagaaaacggatcacctattcgtatccgttaatagcagactggacattttggatatagaggggtttttatgttaattcgttataaaaaatcgtttgaaaagattgcgatggggcttctttcgtttatgccgaatgaaaaagaccttaagcagcttcagcagacaattaaggactacgaaacggatacagaccgccagctctttctttggaaagaggacgaggatatcgtcggagcaatcggagtcgaaaaaaaggattctgaggttgagatccggcatatcagtgtgaatccttctcatcgccatcaaggaatcggaaaacagatgatggatgctttaaagcatttattcaaaacgcaagtactggttccaaatgaattaacgcagagctttttcgaacgttgtcaaggtcagcaggatcaagacatttcatacaataattaagcagaggctgtaatcagcctctgctttagtttgatgacaaaatccgaaaacagttttgttttaggtttttgtcatcctttcagcgcgattgaaaacccttgaagtctaggaaagctgagcattggagcggagcgaatgttttcattcgtgagcaccaacgcacaggcttgacaacgaatgcgagggtttgtcgacacgctgagcagaggctgtcattagcctctgcttttttttctgcgttctatttctttttcacgttcacggatgacgtcagtccgatcccgcaaacggtgtttgtcgataagaaatatgttcctgagtgcactgggctgcccccatgtatacttttttttcttgcattcgaccctgcatgcttcctccagtttctcatctttgattggcagcataatgcttttataggcagagcccgtctcgatttgttcgtaaaccgattgcataagttcgagcaaacggccatgatcaagccctaagtcttcgactgcccggtgttctgcttgaagaatccggatgctgttcgccatcagtctttttgccccggctgtattctgccttctgtgatgatataaagccactgcaagctgaataaagcccacccaatagcgttttcgtttctttggcggatcttccttccaatattcttctaatatttcatggcattcaaaataatcccgtgtcgcgtgaaactcaacgagataatctatataagctttcggatacaaggtgtttcctcctttaatgtgcttttagtgtaccatagaagggataaaagaaaaaagaacgctcggcctctattgcttcttagaaaggaaaaccagaagctaaggctttttctcctgcttctgcgctccgagcaaacacctctcgtgttttgaatattctgtacaaacttgttcaaaacaggaaatgaaatagtattggacgagagctttttggtggcttatactatagggtagccagtttttccggcaatgagagtgatacttgaaaatggtgagatgatggaagaatatcaagtgaaaattgatacgtttgagggcccattggacctgctgcttcatttaatcaatcgtcttgaaattgacatatatgatatacctgtggcgaagatcactgaacaatatttattatatgtacatacgatgcgtgtgcttgagctcgatatggccagcgagtatttggttatggctgccacgctgctcagcattaaaagcagaatgctgctcccgaagcaagaggaggagctttttgaagatgaattacttgaagaagaagatccgcgggaggaactgattgaaaagctgattgagtatcgaaaatataaagatgcggcgaaggatttaaaagaacgggaagaagaaagacaaaaatcgttcacgaaaccgccgagtgatttgagtgaatatgcaaaagaagtaaaacagtctgagcaaaagctctctgtcacggtctatgatatgatcggagcttttcaaaaagtgctgaaacgcaaaaaaataaacaggccgatggaaacaacaattacaagacaggacataccaatcgaagccagaatgaacgaaatcgtgcacagcttgaaatctagaggaacgagaatcaactttatggatctgtttccatatgagcaaaaagaacatttagtagtgacctttctagctgttctcgagctgatgaaaaatcagctggtcctcattgaacaggagcacaatttttcagatatttacattacggggagtgaatccattcatggggcttgatatcgtgaattggaaagctattgtagaagcccttctttatgctgcaggcgatgaagggcttacaaaaaagcagctgttaacagtgcttgaaatcgaagagcctgaactgaacacgatcatggcggatgtggcggacgaataccgcggagatacacgagggattgaacttattgagtatgcagatacgtacatgctctctaccaaaaaagactttgcgccttacttgaaaaaactgattgaagtgccgtcaaagggcctttctcaggcatctttagaagtactggccattgtttcatacaaacagccaattacgagagcagaaattgaagaaatcagaggagtaaaatcagagcggattttacacagtcttgtcgcgaaggcgctattgtgtgaagtagggcgtgccgatggtccggggcgggccattttatacggtactacgccgacttttcttgaacaattcggtctgaaaacgctggacgagcttccgccgctgcctgaaaatgcggaagaagacgttcttcaagaagaagcagatttattttttgaaaactttaaccaaaccttcgaagatataaaatagaagtttaatgaatcgcgctttttcatcatcataagatataaggaagaagctatcatgaaagaagcaaaatgtgagagacaaagacatgaggggaagataccaaacgaaatgggacattcgattgtgcgagcgcagactcaaaaaacaggcgaattcttatcaatggttgtcaataccgtgaacgattacctaaatcaaacgacgcttgagtccttacaggctgaattgcctattgaaaaaggatactgctgtgatgtgctgagcactctgagaagaatggcagtattttgtgaaggaggcgcagaagcgtgccgccgtctcctgatgcaggagccttttcaggaagccagagcggaaaaaacactttataatgtgtatcaccaatgcattgaagagttctttatgccgaaaaaagacacgtggtgtgaaaatagccgggcgtcttataccggggtcagcgcaattgagttttatcatgctgttcctgcgtcgcttgagcaattattattgccgttgagcgcggcctttctgaagatgagggaagagctggctcattacgaagcgtccggatcaagcatggcgccaatcagataacgtttactctccctttttcagggagagtttttttatgtttgcttccagaaatataattgttattcataactgatggacatgcgcataaacttgtacaaaccaccacaaggacgtgagcaaacatgcgcattttcaaaaaagcagtattcgtgatcatgatttcttttcttattgcaaccgtaaatgtgaatacagcacatgctgctatagatgtcagtgcaaaaagcgcgatcattattgacggtgcgtcaggcagagtgttatatgccaaggatgagcatcaaaaaaggcggatcgcgagcatcacaaaaattatgaccgccgtcctcgccatcgaatccggcaaaatggatcaaacagtgacggtttcggcaaatgctgtcagaacagaaggctccgccatttatttaacagaaggtcaaaaagtgaagctgaaagatcttgtgtatggcctgatgctaagatcaggaaacgatgccgctgtcgcgattgctgagcatgtcggtgggagcctcgatgggtttgtttatatgatgaatcaaaaagccgagcagcttggtatgaaaaacacccgttttcaaaacccgcacggattggacgaccatgaaaatcattattcaacagcctatgacatggccattttaactaagtatgctatgaagctgaaagactatcaaaagatttcaggcacaaaaatatacaaagcggaaacgatggaaagcgtatggaaaaacaaaaacaaactgctgaccatgctttatccgtacagcacaggaggaaaaacaggctatacaaaacttgcaaaacggacactggtctctacggcttcaaaggacggcattgacctgatagccgtcaccattaatgaccctaatgattgggatgaccatatgaagatgtttaactatgtgtttgagcattatcaaacctatttaattgcaaaaaaaggggatattccaaagctgaaaggcacattttatgaatcgaaggcttttatcaaacgtgatatcacctatttgctgaccgaagaggaaaaagaaaatgtaaaaattaataccacactgctcaagccgaaaaaagcatgggaaaaagatgcctcgaaaatccctgacatcgtagggcacatggagatcatgttcaacgatgcaaccatcgcaaaagtgccgatctattatgaaaatgagcggcatcaaaaaccgaagaaacaattttttgaaacgtttaaatcaatctttctgaatgcggcaggcggagcaaaatggtcaatataatttgggtcagtttaaccgtgatcggactcgtttttgcgatgtgcaacggaactctgcaagatgtaaatgaagccgtgtttaagggtgcgaaagaagcgattacgatctcatttggattgatgagcgtgcttgttttctggcttggcttaatgaaaatcgccgagcagtcagggcttttggatattttcagccggatgtgcagaccttttatatctaaactgttccctgatataccgccggatcacccggcgatgggctatattttatctaatcttatggcgaatttcttcggcctcggaaatgcagcaactccgcttggcattaaagcaatggaacaaatgaaaaagctgaacggaaaccgatcggaagcaagccggtcgatgattacttttttagctgttaatacgtcctgcatcacactcatcccgacaacggtgatcgctgtccgaatggcttattcctccaaaacgccgacagatatcgtcgggccaagcattttggcaacgcttatttccggaatcggtgccattatcattgatcggtatttttattaccgccgcaaaaagaagggaaggtgagcggatggaaatcatcaactggctgtctttagccatgattccaatcattattgccggaattcttctttatggaacgatcaaaaaggttccgacatatgaatcgtttgtcgaaggcgggaaagaggggatagaaattgccttttccattatcccctatttagtcggaatgcttgtcgctataactgttttcagatcatcaggcgcgcttgattttataatggatcttttaaaaccggctttctccgctatcggcatccctgctgaagtagtgccgcttgctctgatccgcccgatctccggtacggccgcacttggaatgacgaccgatttaattgcagtatacgggcccgattcctttatcggcaggctggcttccgtcatgcagggatctacagatacaacgctttacgtactgactgtgtatttcggagcagtcggcattaaaaaaatgggtgatgcattaaaggtgggacttcttgcagatttaatcggcgtagttgcatctatcatcatcgttacgttattatttgggagcgcctgaaaacggcgttttttttagatttggcataggaatttgaaaaagcttgtttgttaaggttgaaaaaagtaagataatacttgaggtgaaagacatggaaagactgcaaaaagtgattgctcatgccggagttgcgtcgcgcagaaaggcagaagagctgattaaagaaggaaaagtaaaggtgaatggcaaagtagtaacagagctaggtgttaaggtcaccggttctgatcagattgaggtaaacgggttaaaggttgaacgcgaagagccggtttactttctcttatataaaccaagaggcgttatttccgcagcgcaagatgataaaggacgcaaagtggtgacggacttttttaaaaatattccgcagcgcatttatccgattgggcgtctggactatgatacgagcggtcttttgcttttaaccaatgacggcgaattcgccaataagctaatgcatcctaagtatgaaatagacaaaacatacgtggcgaaggtgaaaggaatcccgcctaaagagctgctcagaaagctggagcgcggaattaggctggaggaaggcaaaacagcgcctgctaaagcgaagctgctgtctttggataagaaaaagcagacaagcattattcagctgacgatccatgagggacgcaacagacaggtgcgccgcatgtttgaagcgatcggacatgaggtaatcaagctgaagcgtgaggaatacgcgtttttaaacctgcgaggcctgcacacgggcgatgccagagagcttacgcctcacgaagtaaaaaggctcagagcactggcggatcacggtaaaaacgctttctaaatttcacataaccttcaaaaagtaagaaatgtgaaatgaacgtgcaatgatataattgaatggatctgcaatagggggaagggggcagtggacaatgaagaaaaaaaggcgtttattcattcggaccggcatccttctcgttttaatctgcgcactcggctataccatttacaacgctgtatttgccggcaaagagagtatatccgaagggtccgacgcaccgaattttgtcctagaggatacgaatgggaaacgtatcgagctcagtgacttaaaagggaaaggtgtttttttgaatttctggggtacatggtgtgaaccgtgcaaaaaagagtttccttatatggcaaaccaatataagcattttaaaagccaaggtgttgaaattgtcgctgtaaatgttggggagtcaaagatagcagtacataattttatgaaatcctacggagtcaatttcccggttgttctggatacagatcgccaagtgcttgatgcctatgacgtatctccgcttccgacaacctttttgatcaatccggaaggaaaagttgtcaaggtggtgaccggcactatgacagaaagcatgatacacgattatatgaatctcataaaacccggagagacttcgggatgaagcaagtcaaatgtgaatgcggacatataaacccggtcggaaccgttttatgcgaatcgtgcggaagagctcttcaggaaactcaacctccgctcgctgatatgagatatgacggaagcgcaagacgttcgcaaacctataacaaaacgatcatcgacaaaatttggaatttcttttcctcggttaaggtgggaatatggcttatcgtcataacccttgccgcatcagcgttcggcaccatttttccccaggaagcctatctgcctccgggcgcacaggctgatacttattacaaggagcagtacggcacgtttggccagctttattatttgctcgggtttcatcatttatatggttcttggtggtatttgctgctcattgcctcgatcggcatttcactcgtgatttgcagccttgatcgggtcattccgttgtatagagcgttaaaaaaccaaggtgtcagaaggagcccggcctttttaagaaggcagcgcttgttcagtgaaacagttactgtactgaacggggaatcgaaagaaaagatagttactctattaaagaaaaaacattatagaatcagagaaaaagagggcagcattcttgctgaaaaaggacgcttttcccgctggggcccgtatgtcaaccacattggattgatcatctttctgattggtgcgatgctgagatttgtgcctggcatgtacgtcgatgagacgctttgggtcagagaaggcgaaaccgcagcaattccgggtacagacggaaaatattatttgaaaaacaatcaattcagcgtagagacctataacagcaaaacggaaaaaaaggtatttgcagatgccattgacagagtcggggacggtagagtggcaaagaactttcaaactgatgccgtactctacaagagagaaggaaaaattgtttatggcgagaagccgaagctggaaaaagtaacagaagaagacatccgtgtcaatcagccgctgcgttttgattctttttccgtttaccaggtggattacaaagagaatcagcttgaccaaatggtgttccagctgattgataaaaaaacaaaaaaatcctttgggagcctgaagatcaaccttctggatccagattcagtctatgatcttggtaacggttacaaggtggaaatcgccagctacctgcctgacttctattttaatcaggacggagagccgagcacaaaaacaaagatccctaacaatccggcttttgtctttaatatcataacgccggacaaaccgaaaggcgaaaagagctttgtcgccatccaagaaaccatcgaaggatcaggcaataataaatacaagctgaaatttgaccatgtcgaaacgaaaaacattactggacttacagtcagaaaggatctgacactctgggtgcttgctgtcggcggagccatttttatgatcggtgtcattcaaggtatgtactggcagcatcgaagaatttggctgcactcacaggacggtgcagttatggtagcagggcataccaataaaaactggtttggcctgaagaaggatttagcatttatattggctgattccggactgactgaaccggtggaccaaaaagaattaatcaaaacacagaaataggcgaaaagggagtgatgtcatggcagagctgagcggaaattttctttatgcggcctttcttgtgtatttaatcgctgtcccaatcttcggcggggccatacgcgggaataaagataaaaagggcaggccaaaccgatgggccaacattggaatcaccctttctattgtcggttttttctgccacctaggatatttcatcacaaggtgggctgcaagcggccatgcgcctgtcagcaatatgtttgaattcaccaccgcttttggcatgatgcttgttttggcgtttatcattctttattttctctatagattgccttcattaggcctgtttacgctgtcaattgctttattgctgattgcctacgccagcatgtttccgacagatatctcgcctttaattccttcgctccaaagtaactggctgtatattcacgtaacaacggccgcgcttgggcaagctatacttgccatcagctttgtcgctggtgtcatctttcttttgaagcatgtagaccagacaaagccaagcaaaaagaccttctggcttgaagcgattatgtttatcctggtcacaaccgtcgcctttattgcaatcacatcggcatttcgtcttgcaggctatgaagcggagtttaactgggtggacaaaagtaaagaaaaaagcgtgatggtgtacgaaatgcccgcgcttgtcggtccgcatcagggagagcttttgaccgaaggaagaatggaaccgcttgttgatcttcccgcgcttttctcaggcagaaaagtgaacactgtcatttggtcatttggagcaggtcttgtgttgtatggggctctccgtctgatcatcagaaaaagaatcagcgctctattacatccgctggtgaaaaacgtcaatcttgatctggtggatgaggttgggtacagggccgtatcaatcggatttccgatctttacactcggcgcgctgatctttgcaatgatttgggctcagctcgcgtggaccagattttggggctgggaccctaaggaagtatgggcgctgatcacatttttgttctatgccgcttacttgcatttaagactgtcaagaggctggcacggtgagaagtcagcatggctggccgtaatcggttttgctattattatgtttaatttaatattcgtaaatcttgtgcttgccggacttcattcttatgcatagtcctttgaaagcgacacagttctcaaactttctcacgatttgataaaatgaaagtaacagaaggaaagcagggggaaaacatggaccaaacgaacgaaacaaaaatattagtagttgatgacgaagccagaattcgccgccttttaagaatgtatcttgaacgtgaaaattatgctatagatgaagctgaaaatggtgatgaagccattgccaaagggcttgaagccaattatgacttaattttgcttgatctgatgatgccggggactgatggaattgaagtgtgccggcaaattcgtgaaaaaaaagcgacacccattattatgctgaccgcaaaaggagaagaagcaaaccgggtgcaggggtttgaagcgggaacagatgattatattgttaagccgttcagcccgagagaagtcgtgctgcgtgtaaaggcccttttgagaagagcatcccaaacctcttatttcaatgccaatacaccgacgaaaaatgtgctcgtgttttcacatctgtcaatagaccatgatgctcaccgcgtaacagctgatggaacagaagtgagcctgacgccaaaagagtatgagcttctatatttcttagcgaaaacgcctgacaaggtgtatgatcgggaaaagcttctgaaagaagtgtggcaatatgagttttttggtgatttacggacagtggacactcacgtcaaacgcttgagagagaagctgaacaaggtatctccggaagctgcgaaaaaaattgtcaccgtatggggtgtaggttataaatttgaggtcggcgctgaatgaaattttggaaaagcgtagtaggcaagctgtggtttacgatcctttcactcgtcttgatcgtattgttcattttaacggttcttttgctggagtttattgaaaactaccatgtggaagaagctgagaatgatttaacacagcttgcgaataaagttgctgtcatcctagaaaatcacgaggaccaggcactggcaaggtcaatcacttgggaactcgctgataacttaacaagcattgccatcatccaggatgagaagaaccactggtattctccgaatgataaaaatcgcctgtcgtctattacggttgagcaaatacagcatgacaaagacttaaataaagctctcaaagaccataaaaaagtaagcaaacggacgggactgagcgatacagacacggataatgaacgcctgattgtaggtgtcccgtatgaaaaagacggaaagaaaggcatggtctttttatcccagtctttgcttgccgttaaagatacaacaaaacatacgacccgctatatttttcttgccgctggaattgcgattgtgctgaccacatttttcgcattctttttatcaagcagggtcacgtaccctctccgaaaaatgagagaaggcgcgcaggatttggcgaagggcaagttcgatacaaaaatcccgattttaactcaggatgaaatcggtgaactggcgaccgcttttaatcaaatgggccggcagcttaactttcatatcaatgcgctcaatcaagaaaaagagcagctttctaacattttgagcagtatggctgacggggttattaccattaatattgacggtacgattcttgtgaccaacccgccggctgaacgttttcttcaggcttggtattatgaacagaacatgaatatcaaagaaggcgacaatcttccgcctgaagcaaaagagctgtttcaaaacgctgtcagcactgaaaaagaacaaatgattgagatgacgcttcaaggcagatcatgggtgcttttgatgtcgccgctttatgcggaatcgcacgtcagaggagcggttgccgtactgcgtgacatgacagaagaacgccgccttgataagctgcgggaggactttatcgcaaatgtcagtcatgagctgagaacaccgatctccatgcttcagggatacagtgaagcaattgtcgatgacattgcaagctctgaagaagaccggaaagaaattgcccaaatcatttatgacgaatcgctccgaatgggccgtttagttaatgatttgcttgatttagcccgaatggaatcaggccatacaggcttacattatgaaaaaatcaatgtgaatgagtttttagaaaagatcattcggaagttttccggtgttgcgaaagaaaaaaatattgctttagatcatgacatttctctcacagaagaggaatttatgtttgatgaagacaagatggagcaggtatttaccaatttgattgataacgcgctgcggcatacttcagccggcggcagtgtctccatttcagtccattctgtgaaggatggattgaaaattgatatcaaagactccgggtctggcataccggaagaagatctgccatttatctttgagcggttttataaggcagataaagcgcggacaaggggcagagcaggaaccgggttagggctggctatcgttaaaaatatcgtggaagcccacaacggatcaattactgtgcacagccgaatagataaaggaacaacattttctttttatattccgacaaaacggtaaaatcgagtctgaatttgccgaagaatcttgttccataagaaacacccgctgactgagcgggtgtttttttaatagccaacattaataaaatttaaggatatgttaatataaattcccttccaaattccagttactcgtaatatagttgtaatgtaacttttcaagctattcatacgacaaaaaagtgaacggaggggtttcaaatggaagaaacctttcaattattatatgatacatatcatcaagatttgtaccaatttttattttatatggtaaaggataaaaaccagacagaagaccttcttcaagaggtttatatccgggtattaaattcttatcatacgtttgaaggaagaagcagtgaaaaaacatggcttttgtctatcgcacgccatgttgcgatagactggttccgtaaacagcaaacaatcagacagcgtatactcggtacatttgactgggatacacaggatgtcagggatcagcaattgctgccggacgaacttgcggttcaacatgaaaatgtccgggaaatttatgctgcgcttgatcaatgtacaatcgatcaaagagctgtgattatcttgcggtttattcagggatattcaatacaggaaacagccaaggctctgcgcttctcggaaagcaaagtaaaaacgacccaacacagagggctcaaagtacttcggaaacatatggagcttttgagggaggagctaatggatgatgaagtcagaatggaacgaagaacagataaaggagttgttaagtcaacttccggcagttaaagaccatcgttcgcctcaggatatttacaagcggctgacgatggcaaagcgtaaaaataagcccgctgtcaggtggattggccccgcgtgtgccgctgcaattgcggtttatatcgccttcattatttctcctcatttctttgatcaggcacagcctcaacaaaaagaagcgtcccaagagaacgcagtaacgaaaactgagacagaagacagcccaaaagctgcatcgtccttggatcagacatcgtttgtcgttcctgaaaaggaacaagacaattacatcactgtagcggttgctgatgccgatacatctgcaatcatacccgtcagcattcaaaaaacaaatgcagaccaaacgatccaggatatgctgtttgaaagtagtgaattgggcatccttgatcatgccattacaattccaaccttcatagatgaagtagaaataaaggaaaaaccaaagcagaaggaattaagtatacgagtccatcagccagctacggcattttctataaaagatgatacactgttaaaaaaattgcttaaagaatccttaaaatggagtccttatgaaaaagtcaaatttttatcggatcaaaatgagactggggttcggattggctcatatggcacttttacggaaatttcgattcccaaacagtcaaaacgatcctactacttgtaccaaaataaacaaggacaagactttctcgttccgtcaaatcattcttttgatacagtaaaagaagcgattaaggaaatggaatcgagcagccaagaagatacgacacctcttattcaagcgggtgctgtccaatctgtaacgaagaaacagaaacacttatatatccgcttttcaaaggagtcagaagttgatgattctattgccggtattttaatgattgagggactacttttgactgcaaaagagtttggcttcacagaagtgacctttacggaaaccagaacgaaaaaaatcggcaaatatgacatatcagatgcaattccggtgccagctgctccaaatccgatttccttaaactaaaaagagccctttaaggctcttttttagttgctattcatataatagaaattttcaaaaaaaagttgtacgtgtataataaaacaaggtaaagattgaaaggatttgagacgagtgaacgtgttaacgattaaaggagtttccatcggggaaggaatgccgaaaatcatcattccgctgatgggaaagacggaaaaacaaattctgaatgaagcagaggcagtaaaattactgaatccggacattgttgaatggagagtcgacgtatttgaaaaagcgaatgacagagaagcggtcacaaagctcatttctaagcttcgtaaatctttagaagacaagctatttctatttacattcagaacccacaaagagggcgggagcatggagatggacgaaagctcctatcttgctttgctggaatcggcaatccaaacaaaagacatcgatctgatagacatcgaattattttcaggagatgcaaatgtaaaagcgttagtatcgctggcggaagaaaacaacgtctatgtggtgatgtcaaatcacgactttgaaaaaacacctgtaaaagatgaaattatttccagacttcgaaaaatgcaggacttaggcgcgcatattccaaaaatggctgtcatgccgaatgatactggagatctcctaacactgcttgatgcgacgtatacaatgaaaacaatatatgcagaccgccccattattacaatgtcaatggctgcaacagggctcatcagcaggctgagcggtgaggtttttggatcggcttgtacttttggagctggagaagaggcgtccgcaccaggccaaattcctgtttctgagctaaggagtgtcttagatattttgcataaaaacacacggggatagaacaataaaaaaactcaagctatatagcttgagtttttttaattatggcagatcaatgagcttcacagacacaatatcagggacatttgttagttctttcacaattttatcttccagatgtctgtcaaaggaaagcatcatgatggcttctccgcctttttccttacggccaacctgcatagttgcaatgttaatatcattatctccgagaatacgtcctactcggccgatgacacctgttgtatcttgatgctggatatacaccaagtgaccagtcggataaaaatcaatattaaatccattgatctcgacaattcgttctccgaaatgaggaatatacgtagccgttacagtaaaggtgctgcggtctcctgtcacttttacgctgatgcagttatcgtatccagattcagaagaggaaattttttcactgaagctaatgccgcgttcttttgcgacacccccggcattgacctcattaacagtagagtctacgcgcggttttaaaaagcctgacagaagggcttttgtaatgaacgatgtttcaagtttagcaattgtgccttcatattgaatggcaacatcctgtactggttctttcatgcactgtgatacaaggctgccaatttttcctgcaatttgatggtaaggcttaattttagcaaattcatcttttgtcatggcaggcaggttgatagctgacatgacaggcaggccttttgcgaactgcagaacttcttctgacacttgggcggcgacattgagctgtgcttctttcgttgatgctcccaagtgaggagtggcaatgactaatggatgatcaacaagtttgttgtcaactggcggttcgacttcgaaaacgtcaagcgctgctcccgcaacatgcccgttttccaaagcttcgagaagtgctgcttcatcgataattccgcctcgcgcacagttaattaagcgaacgccttttttcgtttttgcaatcgtttctttattcaataagccttttgtttcttttgttaaaggcgtgtgaacggtaatgatatccgcactttcaagcacttcttcaaatgtacggctgtttacgccgatttttttcgctctttcttccgttaagaaaggatcaaaaacgtgcacagtcataccgaacgctctcgcacgctgtgcaatttcacttccgattcggcctaatcctacaataccaagcgtttttccataaagctctgaaccgacataagctgtgcggttccactctctggatttcactgagatattagcctgcggaatgtgtctcattaaagaagagatcattgcaaatgtatgctcagctgtcgaaatggtgttgccgttcggagcattgatcacgattaccccgtgtttcgtagcctcatcaatatcgatattatcgacaccgacaccggctcttccgacaatttttaaagaagtcattttgttgaaaaggtcttctgttacttttgtcgcgcttcgcaccaaaagagcatcaaaagtatgtaattcatcttctgcatctgctacgtttttttgaacgatttcaataaagtctgattcaataagtggctgtaaaccgtcgttgctcattttgtctgagaccaatactcgaaacatcgttagatttcctcctaaattgacaaactaaatatctgataatttaacatattctcaaaagagtgtcaacgtgtattgacgcagtaaaggataaaagtaaagcctaataaatcaatgatctgacagcttgcaggtaatatatttaatttgaagcaattctctatacagccaaccagttatcgtttataatgtaattaaatttcatatgatcaatcttcggggcagggtgaaattccctaccggcggtgatgagccaatggctctaagcccgcgagctgtctttacagcaggattcggtgagattccggagccgacagtacagtctggatgggagaagatggaggttcataagcgttttgaaattgaatttttcaaacgtttctttgcctagcctaattttcgaaaccccgcttttatatatgaagcggtttttttattggctggaaaagaacctttccgttttcgagtaagatgtgatcgaaaaggagagaatgaagtgaaagtaaaaaaattagttgtggtcagcatgctgagcagcattgcatttgttttgatgctgttaaatttcccgtttccgggtcttccggattatttaaaaatcgattttagcgacgttcccgcaattattgccattctgatttacggacctttggcgggtattgccgtagaagcgataaaaaatgttcttcagtatatcattcagggaagcatggccggagttcctgtagggcaagttgcgaattttattgcaggaacactctttatattaccgactgctttcttatttaaaaaactcaactcagcaaagggcttggctgtcagcctgcttttgggaactgcagcgatgaccattttaatgagtattttaaattatgttctgattcttccggcatacacgtggtttttacattcaccggcattatccgacagcgcgctaaaaacagcagtcgtcgcaggtatcctgccgtttaacatgataaaaggtattgtaattacggttgtattctcactaatttttatcaagcttaagccatggattgagcagcagcgaagtgcacatatccattaaataaaaaagctcccgttcgggagctttttttagttacttctattcaaatttaagcgggtcgccttcaaatggctcatccgccactttgatggaatcagtagggcatccttcaaatgcgtcaatcatatcttcttccagtacctcaggaacttcgacaacacctttgttttcatcaagcgttacgaacgcgatgccttcatcatcgtaatcgtaaatgtctggtgcagcagctccgcaagcgccgcatgcaatacatgtatctttgtctacgattgtgtactttgccatgaataaaacctcccagattgttcttggtggaacaaatggatcaatctttatatttaatcaatttaacacctattcctcttacttattgtaatgatgttgctgccacatttcaacagaaaaatgattgagaatgcttatcacataaggggttatctacataacatcccccttaatgatgactttaaacgtcgatttctgtttgaaatctgttaaaataaaaagagcaaatcaacgatttttgtcaggaagaatgtaggtggataggttgtcattaaattacttcgatattatggttctcgattgtctttgcaaaataaacggggaacggtcgggaagcgctgtttttcacctattcaaaggcaagagatcgtcacagaccattcaagatgccggcttatttcagactgcaaaatactttggaatggcggcaaaatgttcgagaagcgatatttctgcgtcgcttgacaagcttgaaaagcattcatatctcgcgccaatgtctgaatcagatacatacaaagtgacagccagcggcgcagcagttttgagacatgcccttagcgagcggccttggcccgttcattgtcacggcgctcattatcagcaggctgccggcgtgctttggaaaaggctttcgctgcttgtgcaggtcctatcccataaacagcaagggagcaggcagtatatccctgtcacaaaggatcataagacacttcactgggtaaagaaatacctgtcccggcatacggatcatatagagatggcaaaaagcctttttgccatgcttgaggcgcatttgaaaaagattgaaaacaaagcagcgcaaatttttgtctactccttaacctcgcaccatcggatcggttatacgagcaggcagcttgctgatacgctgaaagaagacgaatggtatgtctatatcatgttttgggcttcggtacattattttattcattctcttccggagtgtgaagatgctttgttaaaggatctcctttctgatgtgcacttagataatgccctgacagagtcgacgaggaaaacatggcagatggtcaaacaagggtttccgatacagcgaattgctgaaatcagaaagctgaaaacagcgacgattgaagaccacattgtcgagatttctctccatgagcctgcgtttatgattaatgactatgtatcagcagaagaccagcttcaaatcgcagagtttgccaaacggatgcggacgaataaaatcaaacaaattcgcgacgggctggaacagcggttcagctactttcaaatcagactggcattgacaaagcaggtgcagcaatatgactaaattacagcaaacgttatatcagttttttggttttacttcctttaaaaaagggcagcaggacattattgaaagcatactcagcgggaaggataccattgcaatgctcccgactgggggagggaaatcgctttgctaccagctgcctggttatatgcttgatggcatggtattaatcgtttctccactgctttctttaatggaggatcaggtgcagcagctcaaagcccggggggaaaagcgtgctgcagctttgaacagcatgcttaacaggcaggaaagacaatttgttttagaacatattcatcgatataaatttttgtacttgtctcctgaagctttacagtctccatatgtattggaaaaattgaaaagcgttccgattagcctatttgttattgacgaagcgcattgtatttctgaatggggacacgacttcaggcctgattattcaaagctcggacagctgagaaaaaaacttggacacccacccgttctggcattgaccgccacggctacaaaggaaacgctgcaagatgtcatgaacctgctggagctgcagcatgctgtacgccatctcaactcagtcaaccgcccaaacatcgcactgagggttgaaaatgcggcggatactgccgaaaaaatagatagggtcattcagctggttgaaaacctgcaaggtccgggaattgtttattgtccaacacggaaatgggctaaggaattagcgggtgaaattaaaagcaaaacgagcagcagagccgacttttaccatggcggtttggagtcaggggacaggattttaattcagcagcagtttattcataaccagcttgatgtgatatgttgtacgaatgcgtttggaatgggtgtcgataaacctgatatcagatatgtgattcattttcatctcccgcagacggcagaagcttttatgcaggaaatcggcagagcgggacgcgacggaaagccgagtgtcagcattttgctgcgggcgccaggggattttgaattgcaggaacaaattatccagatggagagtgtcacagctgaagaaatcgccgacgtaatccgtgtgctagagaagacggaggagcgggatgagagaaggctgcgtgacgtattacttcagtatggcgtcggagagacacaggcccgtatgatgattcatctctttatgcagggaaaaacatcagttgaactgatgaagaaagaaatttcatatcgcatggagctgaagctggaaaaaatgcaccgtgtatcatttttgcttcagcgtgacggctgtttaaggcaggcactgttaacctactttgatgaatcatacgagcctgatgacggaaacctcccgtgctgttcacattgcggttttgatttatccttgtatgaacaaaaaggggaacggagtaaaatggcgccattagacagctggagttcggaattgcaccggatattcagcttgcagactgtaggtgagctgaactgaaacagcaaaaagattatattcagcatatgactgaccatgatatgctgaagcagttatatttgacgcagctactcatcatctttgccgctgctgcagcaggactgttcttttttgaggatgtacgggacgtattaaagctctgggacattcgcgatatgcgaatcatctggtatggtgtttctatagctgttattgttattttagccgatatggcagtaatgaaatggtttccgtctcatttatatgatgacggcggaatcaataaaaaaatattcagtaagaggtcaatccctcatattatatttttaacgcttctgattgctttcgcggaagaaatgttattcagaggagtgctgcagactcatatcggtttatggacggccagccttatatttgccgctctgcactttcggtatttgtcaaaatggctgttatttattatggtgacagcaatcagctttttgctcggtctgatgtatgaatggaccggcaacttatttgttccgatgacggcgcattttatcattgatgccgtgtttgcctgtcagattcgttttgaacatgtgaggagggataaacatgacgaacatgtcgagagtagagagaagaaaagcccagaatctttatgaagatcaaaacgccgcattggcggacgattatgtcgatgatggagaaagccttccgacaagacaatctgtaaaaaatcaaagagaacagaaaaaaaagcaaggcaaaacaaaaacgccattattcacagtactcgcagtaatatttgtatttgtgccggttatcgttttagtcaccttattttatctaaagagccacccggataatcatgacgattatgaagatgtttttattgacagcagccaaagcaaatatgaggttgtcccgaaatcagaggacaaaaacgataccgcagacactaaagaaaccgcactgcagaaggagtcaaaaaaagagccagaagattccaagccaaaagagcaaacagctgctgataagaaacagactgctgtagcggaaaaagaagactcgccaaataaggaggaagcaaccgccgcggctgcttcctcttcccaatcaacagtacaacagcaagaacagccagctgagccagttcaaaatgtgccgaatcgcgttgtcaagcacaccgtccaaaagaaagaaacgctataccgcatttccatgaagtattataaaagccggacaggagaagaaaaaattcgagcatataatcatctgaatggaaatgatgtttacaccggacaagttttggacatccctttaatggatgaatagggtattatttttattttacgttcatatattgtagcaatgaaaatggacaaggtgtgaagcgtatggaatccttatggaatcagctggatcagtttacagacgcgccgaccaaacagatgctccaagcgctggtaaaacgaaaacaaaaattcgaaaattatgcagcacaatgccgcagatggcgatgggcttcacttatctgcctaggcttattatgtgttatgatcatgatcaaaagcccggagcctcagcttatacttcaagaaatacttagccataccttttatttattttggatgctggcaaccgcttttgcctactgcacttcatattatttcaagaaaaaggaagaaaaatccgagactgatttccataaactgagatgtgaaattattcagaaaagcactgatctctggccgcagcccgataaatggaaggcgagagagtctgtttttcatatgatgaagcacaaatatgacattaatctatattttgaaagtaaataaaatggggcgttttctcaaacgatagaaacgtcttttttttattgtccgtcttattgataagttctaaaaagaatggagagttttttatgaagctatcagtgaaaattgccggtgtactaactgttgcggcagcggcaatgacggcaaaaatgtatgcaacagcaaaaggcaatcatttgaagacacatacgtttcctttatcaaagatgaagggcaagccgcctctgacaatcttttttatttcagacattcacaaacgtctcatcgatcaagaccttttagaaaaagcgcgaagccatgccccccacttggttataatcggcggtgatttagctgagggcggggtgcccagtgcgagaatcgaggaaaacatcaaaaggctcgtacatttcggggtccctatcgtgtttgtgtgggggaataatgattatgaagtcaggcagcataagctgtattccatatttaaagcgcacggcgtcatcactctgagaaatgagtcagtcccgttttcatacaatgggcatacgattgcgattgcgggggttgatgatatcaggatggagatggatcattatgaggaagccatcaaagaacttgatgaaagccagctgaatattctggtttgccataatccggagattcatgaacaaatcaatgaagatgacggtattgatgtgatactcagcgggcatacccatggaggccagatcaggtttggaaaattcggcccttatgaactggggaaaacaggtattgttaaaaacgcggcatatctgatcagcaacggctacggcacgacaaaagtgcctcttcgtttaggtgctgagcctgaaactcacattgtgactctttgcgggccagaataacttctaaaaagcaaaaatccgtatggcaataaaaactgcattgtgcttgtcttactagtgaactcagtgtaaactgataacaattaagaacctatgactcatcatctcatataatgtgttatatgatttgtgtgcaagtagaggcaggagggaacgttatgcggcttgagcgtctgaattataataagatcaaaatctttttaaccctcgatgatttgacagaccggggattgacaaaagaagacctctggaaggactcatttaaagtccaccagttatttaaagatatgatgaatgaagcaaatacagagctcggctttgaagcgaatggaccgattgcagtggaagtgtattctctccaagcacaagggatggtcgtgattgtaacaaagaaccaagacgccgattcagaagacgatgagtatgatgatgattacatcgaaatgcaagtcaagcttgatgaaagcgcggacatcatatatcaattccattcctttgaagatatcattcagctttcagaaagcttacagcgaatcggtatcacagggggaactgtctaccactatgacgggcagtactttttaagccttgaagatctagggtcacatacggctgaaggggttgtggcggttctggctgaatacggcaatccgacaactttaacgatttatcgcctgcaagagtatggtaagctcattatggacggtaatgccgtagaaacgatacaaactcatttttcataagaatgcaacggaaaactgctgatttcagcagttttttttcgttaaaaaacatggaaaaacataacgtttattctatgcacagatcatatgaaggtgtatactattctctgaaagggagcatgtgagaaacagaagattctaggaggttaactcaaatggcagccgatcgaaacaccggtcatacagaagaggacaaacttgatgtattaaaatcaacccaaaccgtaatacataaggctctggaaaaattgggatatcccgaagaggtatacgaattgttaaaagagccgatgagattattaacggtaaaaatacctgttcgtatggacgacggttcagtaaagattttcacaggatatcgtgcgcagcacaatgactctgtcggtccaacgaaaggcgggatacgttttcacccgaacgtaacagaaaaagaggtgaaggcgctttcaatttggatgagtttaaaatgcggcataattgatcttccatatggcggtggtaaaggcggaattgtttgtgatccaagggatatgtcgtttagagagctggagcgtctgagcagagggtatgtcagagcgatcagccaaattgtcggcccgacaaaagacgtgccggcaccggatgtatttacaaactcacaaatcatggcttggatgatggatgagtattcaagaattgatgaatttaattcgcctggatttattacaggcaaaccgcttgtgcttggcggatctcacgggagagaatctgcgacagcaaaaggtgttaccatctgtattaaagaagcggctaagaagagaggcatcgatattaaaggtgcgcgtgtcgttgtccaaggcttcggaaacgcgggaagctatttggcaaaatttatgcatgatgcgggggcaaaagttgtcggcatctcagatgcgtatggcggactttatgatccggaaggccttgatatcgattatttactcgaccgacgcgacagcttcggtaccgtaacaaagcttttcaacgataccattaccaaccaagagctgctggagctggattgtgatattctcgttcctgctgcgattgaaaatcaaattacagaagaaaatgcccataatatccgggctaaaattgtcgttgaagcagcgaacggaccaacaacgcttgaaggaacaaaaattctttcagaccgggacattctgcttgtaccagacgtgctggcaagtgccggtggcgtaacagtttcttattttgaatgggttcagaataaccaaggcttctactggagtgaagaagaggtagaagaaaaattagaaaaaatgatggtcaaatcatttaacaatatttacgaaatggctaacaaccgaagaattgacatgaggctcgctgcatatatggtcggcgttcgcaaaatggctgaagcttcgcgttttagaggctggatataagttgatgatttgcataaaaataaaaaatctcctatgataaaataggagatttttttattcggaaatagaaaatatgaagtgaaatgccaatcgcaggagttgacagaaatgattcaagaaaaagcaattattataggcggaggaccttgtggactatctgctgccattcacctaaaacaaattggcattgatgccctcgtcatcgaaaaaggcaatgtcgttaacagtatttacaattatccgacgcatcaaacctttttcagctcaagtgaaaagctcgaaatcggagatgtggcatttattacagagaacaggaagcctgtcagaattcaggctttatcgtattaccgtgaagtcgtcaaacggaaaaacatccgtgttaatgcgtttgaaatggtgcgtaaagtgacgaaaacgcaaaataacacattcgttattgagacgtcaaaagagacctacacgacgccatattgtatcatcgccacaggctattatgatcatccaaactatatgggcgtacccggtgaggatttgccgaaagtatttcattattttaaagaaggccacccgtattttgataaagatgttgttgtcatcggcgggaaaaattcaagcgtggacgccgcccttgaactcgtgaaatctggggcgcgtgtcacagttttatataggggcaatgagtattctccaagcattaagccgtggattctgccagaatttgaagccctcgtcagaaacggtacaatccgtatggaatttggcgcttgtgtcgaaaaaatcaccgaggatgaagttgtgtttcgctccggagagaaagaactcattaccattaaaaatgattttgtatttgccatgacaggctatcatcccgatcatcaatttcttgaaaaaattggtgttgaaattgataaagaaacagggcgtccatatttcaacgaagaaacgatggaaacgaacgttgaaggtgtctttattgccggggttattgctgcgggaaataatgcaaatgaaatatttattgaaaacggcaggtttcacggggggcatatcgcagcggaaatcgccaaaagagaaaaccattaaagatgaggagcatatgatgcattcgtatgctctttttgtttttttaagtgcagacagatgtaaaattttaaacaacatggtaggatagacgtaggaatataaaggaaagaggttgcctgatgtttgcaatcatctctgcaggaattgcccccggcatcgcgttattaagttatttttatttaaaagatcagtatgataatgaacctgtacatatggtgctacggtcgttttttctcggggttgttcttgtatttcccatcatgtttatccagtatgtacttgaaaaagagaatgtaggagacggaagctttttcgtttcttttttatcttcggggtttttggaggaatcattaaaatggtttatactgatgatcagtgtctacccgcacgcccactttgatgagcattatgacgggattgtgtacggtacaagtgtatcactcggttttgcaaccctcgaaaatattctttatttaattggccacggcgtggagcatgcgtttgtcagggcgctgctgcctgtttcatgccatgccttgattggcgttataatgggattttaccttggaaaagcccgtttttccgctgataaggcgcgtgtaaagtggcttactctttctttagttgtcccatcccttttgcatggatcatatgattttatcctaacagcgcttagcaattggatttattatatgcttccatttatggtatttttatggtggtttggtttgcgtaaagcgaaaaaagcccgttccgttaatatgatgcaagtatagaagccgcacagcaaccgtgcggcttttttgtgtgcagtttttatgttctgagggataacaaggaaagagtgtataaaaataacctcgttacagaaaatacgattacacttaaaaatttgcagtaggaggcttgaaaagatgaagtccaaaggatcgattatggcatgtctcatccttttttcctttacaataacgacgtttattaatactgaaacgatctctgccttttcgaatcaggtcattcaaagaggggcaacaggggatgatgtggtcgagcttcaggcgcgtcttcaatacaacggatattataacggaaaaattgacggggtttatggatgggggacgtactgggcagttcgaaattttcaggatcaattcgggttaaaagaggttgacggccttgtaggagctaaaacaaagcaaaccttaatatgtaaatcaaaatactatcgtgaatatgtcatggaacagctcaataaagggaatacattcacgcattacggaaaaattccgctaaagtatcagacgaaaccatcaaaagcagcaacacaaaaggcaagacaacaagcagaagcacggcagaaacagcctgcggaaaaaacaacgcagaagcctaaagcgaatgcgaataaacagcaaaacaatacaccagcaaaagcaagaaaacaggatgcggtagcagcgaacatgcctggtggattttccaacaacgatatcaggctgcttgctcaagcggtttatggcgaagcccggggcgagccgtacgaggggcaggttgctattgcagcagtcattttaaaccgtttgaacagcccgttatttccaaattcagtagcgggggttatttttgagccgcttgccttcacagcagtagccgacggacaaatttacatgcagccgaatgaaacggcacgagaagcagtgctggatgccatcaatggctgggacccatcagaggaagcactttactactttaatccggatacggctacaagtccgtggatttgggggcgtccgcagattaaaagaatcggtaaacacattttctgtgagtagcagatatgagaaagcataaaaagaggtgtgataaatgatcagaggaattttaatcgccgtgcttggtattgcaatagtcggtacaggctactggggatacaaagaacaccaggaaaaagacgcagttcttcttcatgctgaaaataactatcagcgggcgtttcatgagcttacctatcaggtggatcagcttcatgataaaatcggaacaacacttgccatgaacagccaaaaatcactgtcgcctgcattgatcgatgtgtggaggattacatcagaagctcataacagcgtcagtcagctgccgcttacattaatgccgtttaataaaactgaagagctattatcaaagatcggcgatttcagctataaaacgtcagtcagagatttggaccaaaagccgcttgataaaaacgagtatacatcactaaataagctatatcagcagtccgaagatatacaaaatgaattgcgtcatgttcagcaccttgtcatgagcaaaaaccttcgctggatggacgtagaaatggctctggcttctgacgaaaaacaaagtgataatacgattatcaacagctttaaaacagtcgaaaaaaatgttggtgcattctccactggcactgatcttggcccgagtttcaccagtacgaaaaaagaagagaaaggcttcagccatctgaagggaaaacaaatttccgaacaggaagcaaaacaaattgctgagcgctttgccccagatgacaattattcaattaaagtggtaaagagcggaaaaaaaacaaatcgcgatgtatatagcatcagcatgaaagacccagaccataaagcagtgatttatatggatattacgaagaagggcgggcatccggtatacttgatccaaaacagagaagtgaaagatcagaaaatcagtttaaatgacggatcgaaccgagcgcttgcatttttaaagaaaaacggatttgaaacagatgatttggaaattgatgaaagtgcccaatatgataaaatcggtgtattttcatatgttcctgttgaaaataaagtccggatgtaccccgaggcaattcgtatgaaagtggccttggatgacggtgaggttgtcggcttttcagcaagagacttcctcacatctcacagaaaaagaaccatacctaagcctgcaattactgaagcagaggcaaagtctaaattaaataaaaatgtacaagtgagagaaacaaggctcgctttgattacaaatgaactaggtcaagaagtgttatgctacgaaatgcttgggacaattgaaaatgacacattcagaatgtatatcaatgccaaagacggatcggaagaaaaggttgaaaaactaaaaaatgcagaacctatatataaagacctataaaaacaggaggaaaggactaaatgtcttttcctttttttcattacgtgctttaataaaaacgtgagtatattgaatgcgaaagagtgaagtcaatgatagagattggagaaaatgtacttttagaatatatagaagaaaatgaattgaaaaaggcaaaaagcaaggcggtcagcatcgaaaacaatgaacttttgatcgcgtatcctgttgatgtagttacagggcgaactgtgattttacataacgatatggaagtaacggtagagtttgtgggaaaagacgaagttccttatcgctttataagccgtataaaaggtaaagtgaaggacaaacttcaaatgatctgtcttgaaatgcctccccgtgaaaaaatgaaaagaatccagcgccgccaatatgtaagaactgatgcggtattagatgtgcaaattcagccgggaaatgaagaagagatccgcacactatcctataacatcagtgcaggcggcatcgccgtggttttagctgatggcctttcttttcaatcgggggaatcattgcgcctgatcatccttcttcctgaagaggagcacacacgtcaaatagaaacagaagcagttgtcagacgaatctttaatgaccccaagtcagaaaaacgaaaaatgactttagagtattcagaaattgcagcaggtgaccagcaggctttgcttcaatactgcatcaggcgccagttaaataagagaagaaaggcccgaatggaataaacatcggcaaacacttccatactatttgtaatggaggtgctccaatgaaaacatttgaacggctgctgatcaaattattgttcattcaggccatcattttacttggtgtccaatttctttttcactatcagcatattgaaccatacgtatcaaaagtgattcaatatgaaggggtggataaaatggaggaaaacaataggattgaaaccttcaaacattaattattcatcaatttttcaccctttttcataaagttcgtgatacaatccttagaggagaaaagagcaaggagaggaattatggaaaagaaattatcgattgcaatcgacggcccggcagctgcggggaaaagcaccgttgccaaaattgtggctgagaaaaaatcgtacatatatattgatacaggagcgatgtatcgggcgattacgtacgcggctttacaggaaaacgttgatctgacagatgaagaaaaactggctgagctgctaaagcggacagacattgagctgattacaacaaaagatggacaaaaagtgtttgtaaacggcaccgatgtaactgaggcgatcagaacagatgaaatcagcaaccaagtttcaattgcggccaagcacagaagtgtcagagaagaaatggtgaaacgccagcagcagcttggggaaaaaggcggcgtcgtcatggatggtcgtgacatcgggacgcatgtgctgccaaatgcagaagtaaaaatctttcttttggcatctgtggaagagagagcgaaacgccgttatgaagaaaatgtgaaaaaaggctttgatgtcaactacgaaacattaattgaggaaattgcaagaagagacaagcttgattcagagcgcgaagtatctccgctgcgtaaagcagaagacgctcttgaaatcgacacgacatcgctttccattcaagaggtagctgataaaatcctcgaggctgtggagcaaaagtcccgctgaggatggcaaatgccactttttttgaatttttcaacgaagatagaatgttattgcttgacaaacctgtccttttattagaagttaatactaataaaactttttattgatcattcaaaaaacttttttggatgattctttaatacatattcggctaaaagcgggcatgttatatgttcagctttcaaaccgttttaattaagctgtgtaggtttggaccaaggaggttattcaaatgacagaggaaatgaatcaaattgatgttcaagtgccagaggttggagatgtagttaaagggattgtgacaaaggtagaagacaaacatgtagatgtagaaattatcaatgtcaaacaatccggtattattccaatcagtgaattatcaagtcttcatgtagagaaagcatcggatgttgttaaagtagacgacgagcttgacctgaaagtaacaaaagtggaagacgatgctttgattttatctaaacgtgctgttgatgcagaccgcgcttgggaagaccttgagaaaaaatttgaaacaaaagaagtgtttgaagctgaagtgaaagatgtcgtgaaaggcggccttgtcgttgatatcggcgttcgcggttttattccggcatcacttgttgaagcacatttcgttgaagacttcactgactataaaggaaaaacactgtcactgctcgttgtagagcttgaccgtgataaaaaccgcgtgatcctttcacaccgtgctgttgttgaaagtgaacaagcgaataaaaaacaagaacttcttcagtctcttgaagttggaagtgtacttgatggcaaagtacagcgcctgactgactttggcgcgtttgttgatattggcggcatcgacggacttgtacacatttcacagctttcccactctcatgtagagaagccgtctgacgttgttgaagagggacaagaagtaaaagtgaaagtgttatcggttgaccgtgataatgaacgtatttctttatcgatcaaagatacactgcctggaccttggaaccaaatcggcgaaaaagtgaagcctggcgatgtgcttgaaggaactgtacagcgtcttgtaagcttcggtgcctttgttgaaatccttccaggtgttgaaggtctcgttcatatttctcaaatttccaataaacacatcggcacgccgcatgaagtccttgaagaaggacagactgtaaaagtgaaggttcttgatgtgaatgaaaatgaggagcgcatttcattaagcatgcgtgaacttgaagaaacgcctaaagctgaccaggaagattaccgtcaatatcaagcgaaggaagaaacaagcactggcttccagcttggagatctgatcggagataagctgaataaactaaaataattggtgataaacgtgactcgagcagaacgaaaaagacaacacatcaatcatgccttgtccaccggccagaagcgggaaacaggtcttgatgatattacgtttgttcacgtcagtctgcccgatcttgcattagaacaagtagatatttccacaaaaatcggcgaactttcaagcagttcgccgatttttatcaatgcaatgactggcggcggcggaaaacttacatatgagattaataaatcgcttgcgcgagcggcttctcaggctggaattccccttgctgtgggatcgcaaatgtcagcattaaaagatccatcagagcgtctttcctatgaaattgttcgaaaggaaaacccaaacgggctgatttttgccaacctgggaagcgaggcaacggctgctcaggcaaaggaagccgttgagatgattggagcaaacgcactgcagatccacctcaatgtgattcaggaaattgtgatgcctgaaggggacagaagctttagcggcgcattgaaacgcattgaacaaatttgcagccgggtcagtgtaccggtcattgtgaaagaagtcggcttcggtatgagcaaagcatcagcaggaaagctgtatgaagctggtgctgcagctgttgacattggcggttacgggggaacaaatttctcgaaaatcgaaaatctccgaagacagcggcaaatctccttttttaattcgtggggcatttcgacagctgcaagtttggcggaaatccgctctgagtttcctgcaagcaccatgatcgcctctggcggtctgcaagatgcgcttgacgtggcaaaggcaattgcgctgggggcctcttgcaccggaatggcagggcattttttaaaagcgctgactgacagcggtgaggaaggactgcttgaggagattcagctgatccttgaggaattaaagttgattatgaccgtgctgggtgccagaacaattgccgatttacaaaaggcgccccttgtgatcaaaggtgaaacccatcattggctcacagagagaggggtcaatacatcaagctatagtgtgcgataaatgataaaagcccaaaaccatatgtggtttgggctttttgtattatgattttcgctttttgaatcttccgttttgttcaaggcttgtcgctccgtcatagtgaatggactggtcgcgatctgattcgactctgcctgaagctttgagttttttctcttgtctgtcttttcccatgatcatactccttaatgtgagatcgattgtttaaaaaatgtgcttgaactccatactgggaatatggaggaagtaaaatggaacaattttattactattggtcaatgtggtttctgtgggttctgacaacatttatttttgaaaagacgaaaagacgaattgccgtctctgtctttattttaactaatattattctaagcatacatgacatcgctttatatttttccctgaatgctgcatatttgatgtttttcgtttgcggatgtgtctatgccgggtatttgggaatgtatcgttttcgttacatcatggtctatctgacgcttgttgccgcgtatgcgtttgtttatctttttgcattatatgacccggtttggttcatcataaaacctgagtgggctgctgttatattaatagtgcttttaacagcttctgttgaaaggaattttgagaagcagcttgtcttatttgtcctagggatgtgccaaggcgaactggtgtattcatttgtgatccagaagttggccggggctatggctgtcggcggctttcaatggctgaatgcgtgttctgcggggatgatattgctgtttggcatatctaaatacgaacacctcgcaagccagattggtcagaaaagcaaaagatcaaacaaaggagctaccaaaatgtcatgagtgattacatctatccgattattgctggggtcattgccggaattgcgacaaggctttatatgctgaaaacggattaccgccagtatccgacctatgttcatgggaaagtgattcacatcgcactggggttgatagcggctggtttaggtgcaattattatgccggcgcttttgcaggaggaatttacggccatcacatttttaacattggcagcgacgcaatttagagatgtccgaaacatggagcggaacacattgacgcaaatggattcgtatgaacttgtctcaaggggaagcacatatattgaggggattgccattgcgtttgaaagcagaaattatattgtgatctttacagcgcttttgacaacctctgcgtatgtgtttttatccatctgggctgcagtcatagcggctgtcgtttgttttttactggccatgaagtttatgtcgggcagtgtgttgaaggatattgtagatatcgagtacataaagccgcgctttgacggtccgggactgtttgttgataatatttatatgatgaatatcgggcttccagagaaacaggaactgattttaaagcatggcatgggctttattttgacgccgaaaaactttaattcagcagcgacgatagcaaatttagggcagcgtcaggccattttatttgatgtttccaatgtgctcggggtttatcgggattcaggagagccatctttgacaccaattgcaaaacgggatttaaatgatgggagagtggcagtatttgttctcccgcaaattcaccatcccgaaacggctgttcaaattattagcaatgttccaaccctggaaaatgcgattagaatgccgactgaatttatcaagaatcaggataaggtgataggatgagtgaatctcttacgaaagtgattttgtctgtaatcacgacaaatcgaaatcgggttgcagggggagcacctgtctttttttgcaatgaccaaaaggagatggagcttttcgctaaaaatcttgaggcgatccttgatggaatagctcacagaatcggagatgacgtgtatttgatcgtgaaacatttttaagaatagttgtgatcccagtaaaaactgatataataaatgagttaagcccttcctctgaagggtttcttttcataaaagtgaatgaaatgattttaataaccggttgaaaatttatgtaaaaatgaaagcggctggattgaaaggaagggtactatgggtaaacctgtcgtagccattgtcgggagaccaaatgtaggaaaatccacaatctttaaccggattgcgggagaaagaatttcaatagtagaagatacccctggcgtgacaagggatcggatatacagctcggctgaatggctgaattatgattttaatttgattgatacgggcggtattgatatcggtgatgagccgtttttagcgcagattcgccagcaagctgaaatcgccatggatgaagcggacgtgattatttttatggtgaacggccgtgaaggcgtgacagctgctgatgaagaagtggcgaaaattttgtaccgcacaaaaaagcctgttgttttagcggttaataaactggataacacagaaatgagagcgaatatttatgatttttattcgctaggctttggcgagccgtatccaatttcgggaacacacggactcggactgggtgatttactggatgccgttgcagagcattttaaaaacattcctgaaacgaaatacaatgaagaagttattcaattctgtctgatcggacgtccaaatgtcggaaagtcttcacttgtgaatgcgatgctcggcgaagaacgcgttattgtcagcaacgtggctggaacgacaagagatgctgttgatacgtcatttacttacaaccagcaggagtttgtcattgtcgatactgcaggtatgcgaaaaaaagggaaagtctatgaaacgactgagaagtatagtgtactgcgggcgctaaaagcgattgaccgctcagaagtcgtggcggttgtgctggatggcgaagaaggcattattgaacaggacaagcgtatcgccggttatgcacacgaagcgggcaaggccgtcgtcatcgtcgtaaacaaatgggatgctgttgacaaagatgagagcacgatgaaagaatttgaagaaaatattcgcgatcattttcaatttctggattatgcgccaatcctatttatgtctgccttaacgaaaaaacggatccatactctgatgcctgcgattatcaaagctagtgaaaatcattcacttcgagttcaaacaaacgtcttaaatgatgtcatcatggacgctgtggcaatgaatccgacaccgactcataacggttctcgtttgaaaatttactatgcgactcaagtgtcggtaaagccgccaagcttcgttgtgtttgtaaacgatccggaattgatgcatttttcatacgaacggtttttagaaaaccgaatcagagacgcgttcggttttgaggggacaccaatcaaaatatttgcaagagctagaaaataaaaaggtgtgaatcaaacatgaaaaaagtcacaatgcttggagcggggagttggggaacagcactggctttagttctaactgataatggaaatgaagtgtgtgtgtgggctcaccgtgcagatttaattcatcaaattaatgagttgcatgaaaacaaagattatttgccgaatgttaagctgtctacatccattaaaggaacaacagatatgaaagaggctgtttcagacgcagatgtcattatcgttgcggtcccgacaaaagcaattcgggaagtgctgagacaggctgtcccttttataacgaaaaaggcagtctttgttcatgtcagcaagggtattgagccagattcacttctgcgcatttctgaaattatggaaattgagctcccgagtgatgtcagaaaagatatcgttgtcctttccggcccgagtcatgcggaagaagtagggctgcggcaccccacaactgttactgcatcttcaaagagcatgagggcagcagaagaggtgcaggatctatttattaatcacaattttcgggtgtacacaaatcctgacattatcggagttgaaatcggaggggctttaaaaaatattattgcccttgctgcaggaattacagatggtttagggtacggtgacaatgccaaagctgctttgattacacgcggacttgccgaaatcgcgagactcggaacgaaaatgggcggaaatcccttgacgttctctggattgacaggagtaggcgatctgattgtgacgtgcacaagtgttcattccagaaactggcgtgcgggcaatttgctcggaaaagggtacaagcttgaagatgttcttgaagagatgggaatggtagtcgaaggcgtccgcacgacgaaagcggcttatcagctttcgaagaaatatgatgttaaaatgccgattacagaagctctccatcaggtcctattcaacggacaaaaagtggaaaccgctgttgaatctttaatggcgagagggaaaacccacgagatggaggatttggtaaatacgtttgaaaatcaagtgaagtaaaagtgtcaatcaaatggtgaatcgcatatcttaattgaacgaaagcccgaaaaacagaagaacacccaagtcttgggatctcctgaaacattttgccgatttaggcaatagaggatgcatctgtatgccaagtcgcatactatagcatcgaagtccaagagagtgtttcttaaacgtgcaggtgaatatagtcaagttgactgaagcgaaggtccccctctttgcttcagtttttttgttctatcaatggatggaaaatctggttgatcttttccggcgctgtatattaaaatataatataactcttacatcttacatatcggggaggcgcacgtcattgaatctggcattgatgaaaatgtggtttgctctagggtccatgggtctgatgtttctggctgtagcttccatctatttaagccgctttaagtgccaaaaccgttttttgaagattgcgatttcatcattcgcatacatgtgtatgctcatatctggaattattgtgtttgtcgtggtttttagcggccctgtcaatgaataaagctgtaaaaggaagtgctgtatgggtaaactgaagtgcgcaatcatttttgcggcagtcgtgtttttatccggatgtttatatccaaatgaacggaaaagcagtgtgcatgccattccttatcaagaccagctaaagcaggttcaatctgctgttgatgaatttcaaaaggcaaatggagggctgcttcctattcaaaccaaagatatgtcgacaccgctatatcaaaaatatccgatagactttaaccggttagcgccaagatacatagctgaacctccaagtacggcatttgaaagcgggggagactatcaatacgtgcttgttgacgtagagaacgatccgactgttaaattaattgatctaaagatggcagaaaaaattcgcgatgtgaaattgcgcatccaaatgtatcgtcaggagcatcaatatccgccttacaaggatgtgctatctcgtgatttatttacactcgatgagaagaagcttggggatggcagctctcttacagtgacaagcccaatctcagggaattccttgccgcttatgattgacggagacggagaaatatatgccgattaccggactgagctggcttcttgcctcaaaaaaagcaaaaaaacgtttaaacccgggactgaaatccaggatatgatttggcatgaaaccccctttgtccccgtgttttctgtaaaatatacggtaaatgacaaacaggaacctgtttttttagaaaatgatatgaaaaaggaatgaacctttctcccttgcatacaaatagggagaaaggtttttttatattaatagattgaggatgagaaattttctaaagatgtcatattcaaataggacaacgtcatacacatatagtgtcctgtgtttgattgaaagagcttaataaaattgaaaaggataggaagtccgggaggggatcacttggaaaaggtcgatattttcaaggatatcgctgaacgaacaggaggcgatatatacttaggagtcgtaggtgctgtccgtacaggaaaatccacgttcattaaaaaatttatggagcttgtggtgctcccgaatatcagtaacgaagcagaccgggcccgagcgcaggatgaactgccgcagagcgcagccggcaaaaccattatgactacagagcctaaatttgttccgaatcaggcgatgtctgttcatgtgtcagacggactcgatgtgaatataagattagtagattgtgtaggttacacagtgcccggcgctaaaggatacgaagatgaaaacgggccgcggatgatcaatacgccttggtacgaagaaccgatcccatttcatgaggctgctgaaatcggcactcgaaaagtcattcaagaacactcgaccatcggagttgtcattacgacagacggcaccattggagatatcgccagaagtgactatatagaggctgaagaaagagtcattgaagagctgaaagaggttggcaaaccttttattatggtcatcaactcagtcaggccgtatcaccccgaaacggaagccatgcgccaggatttaagcgaaaaatatgatatcccggtattggcaatgagtgtagagagcatgcgggaatcagatgtgctgagtgtgctcagagaggccctctacgagtttccggtgctagaagtgaatgtcaatctcccaagctgggtaatggtgctgaaagaaaaccattggctgcgtgaaagctatcaggagtccgtgaaggaaacggttaaggatattaaacggctccgggacgtagacagggttgtcggccaattcagcgagtttgaattcattgaaagtgccggattagccggaattgagctgggccaaggggtggcagaaattgatttgtacgcgcctgatcatctatatgatcaaatcctaaaagaagttgtgggcgtcgaaatcagaggaagagaccatctgcttgagctcatgcaagacttcgcccatgcgaaaacagaatatgatcaagtgtctgatgccttaaaaatggtcaaacagacgggatacggcattgcagcgcctgctttagctgatatgagtctcgatgagccggaaattataaggcagggctcgcgattcggtgtgaggctgaaagctgtcgctccgtcgatccatatgatcaaagtagatgtcgaaagcgaattcgccccgattatcggaacggaaaaacaaagtgaagagcttgtacgctatttaatgcaggactttgaggatgatccgctctccatctggaattccgatatcttcggaaggtcgctgagctcaattgtgagagaagggattcaggcaaagctgtcattgatgcctgaaaacgcacggtataaattaaaagaaacattagaaagaatcataaacgaaggctctggcggcttaatcgccatcatcctgtaataccggtagacctctttatagaatgggaggtcttttttctttgctcttaataatggaaaaggatcaaggaataggatgaaaaaaggaaaaaaaggaatattcgttcggtaaatcaccttaaatccttgacgagcaagggattgacgctttaaaatgcttgatatggctttttatatgtgttactctacatacagaaattcttcactttgttggacaaacattcctcagagtgcagtttttcttaaaaagccgtttaattgtctttctcttacttgctctcatttttttctgagacaggtttagaatcagactgaactgtgaagaaatgataataaacgaactgaatgtatccttttgggaggaggtgaaaggcatgaacaaaacagaacttatcaatgcggttgcagaagcaagcgaattgtctaaaaaagacgctacaaaagcagttgactctgtttttgatacgatcttagatgcacttaaaaacggtgataaaatccaactgatcggttttggtaacttcgaggtgcgtgaacgttctgcacgtaaagggcgcaaccctcaaacaggtgaagaaatcgaaattccagcaagcaaagtacctgctttcaaaccaggtaaagcgcttaaagacgcagttgccggaaaataattgtgaatatagatcgtgtatgcatctagcttacatacactttatttcttcacagaaaagcccctttctaaggggcttttcatatttcaagagcatgggcttcctgacagggcattcactttgcttttagcggggcatatgtgctagaatcgaaattaaatgtattcattggtggaggacatagaacatgaaagaagttaataaagagcaaatcgaacaagctgttcgtcaaattttagaagcgatcggagaagacccgaatagagaagggcttcttgatactccgaaaagagtcgcaaagatgtatgccgaagtattctccggcttgaatgaagatccaaaagaacatttccagactatcttcggtgaaaaccatgaggagcttgttcttgtaaaagatatcgcatttcattctatgtgtgagcatcaccttgttcccttttatggaaaagcacatgttgcatatatcccgcgaggcggaaaggtcacagggctcagcaaactggcacgtgccgttgaagccgttgcaaagcgcccgcagcttcaggaacgcatcacttctacaattgcagaaagcatcgtagaaacgcttgatccgcatggcgtaatggtagtggttgaagcggaacacatgtgcatgacgatgcgcggtgtaagaaaaccgggtgcgaaaactgtgacttcagcagtcagaggtgtttttaaagatgatgccgctgcccgtgcagaagtattggaacatattaaacgccaggactaataaagatagagggtgctataaatgaaccaaaagcattcaagtgattttgtcgtcattaaagccgttgaggacggagtgaatgtgatcggcctgacaagaggaacagacacaaagtttcaccattccgaaaaactcgacaagggagaagtgatcatcgctcagtttacagagcatacttctgccattaaagtcagaggagaggcactgattcaaaccgcgtacggagaaatgaaaagcgaaaaaaaataagctggctgtccccgctgttaaaagcaaatgctcgcaaacagcgggaggatacagccaatttcttttttttatgctataatgatacctgcgtaagcgaatgaaaagataaaactcatacatagattaagaaataaatgtgaatttggggacaagggtgatatttttgcaagacatctacggaactttagccaatctgaacacgaaattaaaacaaaagctgtctcatccttatttagcgaagcatatttctgcgccgaaaattgatgaggataagcttcttctttttcatgctttatttgaagaagccgacataaaaaacaacgacagagaaaattatattgtaacagcgatgcttgtacaaagcgcccttgatacccatgatgaagtgacgacagctagagtcataaaacgagacgaaaacaaaaaccgccaattgactgttctcgcgggcgattatttcagcgggctgtactactctttactatctgaaatgaaggatatctacatgattcggacgcttgctacagccattaaagaaatcaacgaacataaaattcgtctgtatgaccgttctttcaaggacgaaaacgattttttcgaaagtgtcggcatcgttgaatcagctttattccatcgtgtggcggaacacttcaaccttccgcgctggaaaaagctgtcgagtgatttttttgtatttaagcggcttatgaacggaaatgatgcatttctggatgtgatcggcagttttatacagctgggaaaaacaaaagaagagatattagaagattgttttaaaaaagcgaaaaacagcattgagtcacttctgcctctaaattcacctattcagaacattttaataaaccgtctgaagacaatcagccaagatcaaacctatcatcagaaagtggaagaagggtaaaccattatgcaggactcaaaagaacagcgcgtacacggagtatttgaaaaaatatataaaaactatgaccaaatgaactctgtcatcagttttcagcagcataaaaaatggcgcgacaaaacgatgcgcatcatgaatgtaaaagaaggcgcaaaagcacttgatgtctgctgcggaacggctgactggacgatcgctcttgcaaaagcggccggcaaaagcggcgagatcaagggcttggatttcagtgaaaatatgctgagtgtcggcgagcagaaagtaaaagacggcggattcagccaaattgaactgctgcacggaaatgcgatggagcttccttttgatgatgatacatttgattatgtcaccattggcttcggactccgcaatgtccctgattacttgactgtactgaaagagatgagacgtgtagtgaagccgggcgggcaggtggtatgtctggaaacgtcccagccggaaatgatcggattcagacaggcttactttatgtactttaagtatattatgccgtttttcgggaaactgtttgcgaagagctataaagaatattcttggcttcaagaatcagccagagatttccctggaatgaaggaactggcaggcctgtttgaagaggcgggcctgaaaaatgttaaatatcattcgtttactggcggagtcgctgccacgcatatcggatggaaatgaaaacacagatgtttgggtgaatgatatgaaatttaaaatggcctactcttttttaaatgacgatattgatgtaatcgaaagagaacttgaacaaaccgtacgttccgattacccgcttttaagcgaggcaggtcttcacctgctgcaggccggagggaaacgtattcggcctgttttcgtgctgctttctggcatgtttggcgattacgatattaataagattaaatatgtcgccgtcactctggaaatgattcacatggcatctttggttcatgatgatgtcattgatgatgcggagcttcgccgaggaaaaccgacaatcaaagcaaagtgggacaatcgtattgcgatgtacacaggcgattatatgcttgcgggatctcttgaaatgatgacgagaattaacgaaccgaaagcccataggattttgtcacagacgatcgttgaagtttgtctaggggaaattgagcagatcaaagacaaatacaacatggaacaaaatctcagaacgtatctccgccgtatcaaaagaaaaacggctctcttgatcgcggtcagctgccagcttggtgctattgcgtctggagctgatgagaagattcataaggcattgtactggtttgggtattacgtcggcatgtcttatcagattattgatgatattcttgattttacttcaactgaagaagagctgggtaaacccgttggaggagatttgcttcaaggaaacgtcacattgccagtgctgtatgccctgaaaaatcctgcattaaaaaaccagcttaaattgattaacagtgagacaacgcaggaacagcttgaaccaatcattgaagaaatcaaaaaaacagatgcaattgaagcatctatggcagtaagcgaaatgtatctgcagaaagcttttcagaaattaaacacgcttcctcgagggcgcgcacgctcatctcttgcagccatcgcaaaatatatcggtaaaagaaaattttaatttttttgtagatattaagaaatttctccgccccggattgattaattatcagaaagatgttacgatttcggtgtgcagtgtgaaagcctatacatacataatgatggggtggagaatatgatggaaaagacttttatcatggtgaaaccagacggtgtccaacgtcagctcattggggacattttatctagattcgaacgtaagggcttacaattagctggcgccaagttaatgagagtgactgaacaaatggctgagaaacactacgccgaacatcaaggaaagcctttcttcggagagctcgttgagtttattacttcaggacctgtattcgcaatggtgtgggaaggcgaaaatgtcattgaagtgacgagacagctgatcggaaaaacaaaccctaaagaagctttacctggtacgattcgtggggattatggcatgtttgtcggaaaaaacatcatccacggctctgattctctcgaaagtgcagaacgcgagattaacattttctttaagaatgaagaattagtatcatatcagcagcttatggcaggctggatctattaatcattgtgaaaataagcaacagagccggcatcatataacgccgccggtttttgatctgttttgtaaaggtttacattaaagtgaataaagtgttgattggcagtgtgcatcagacctctgcctttcccaacgatctaaaatcagctgaaaagctgatttttttattgaaacaatacaatttcctgataaaacaagctatactaggacaaaaagacagcgagactgggagagtagagatggatacatacagcgtatttacaacgaaatggaaacaattaaccggagtcgatttgacactatataaagaagcacaaatgaagagaaggctaacgtcactttatgagaaaaaggggttccaaagctttaaggactttgctgcggcattggaaaaggatcaagctctcttaaatgaaacattggacagaatgacgatcaatgtttcagaattttatcgtaattataaaagatgggaagttcttgagactgcaattctgccgttaatcaagacctctaggcctttaaaaatttggagtgccgcctgctcaacgggggaggagccatacacgcttgccatgcttttggaccagcaaaaaggtcttccgggctatcagattttagcgacggatattgatgaaaaagcattggaaaaagcgaaaaaaggcgtttatcaggagcggtctttacaggaagtgccgctatctgtgaaagatcgttattttacgcaaaacgcaaatagaagttatgaagtgaaaacggaaatcaaaaagaatattacattcaaaaagcacaatttgctggcggatcgttatgaacaagactttgacttaatcgtgtgccgcaatgtatttatttattttacagaaagcgcgaaggaagagctgtatttaaaaatggcacatagcttgaagaagaatggagttctttttgtcggcagcaccgagcaaatcttcaatcccgagaagtttggcctagtcccagccgatacattcttttatcaaaaaagatagactgactttttgctgaaaaatatgttatagtagtcttacttaaaagcgttaatgcgatgaagggagaagaagtcatgagatatttaacagccggagaatcacacggcccccaactgacaaccattattgagggtgtacctgccgggctttacataacggaggaagatatcaattttgagcttgccagacgccaaaaaggacacggccgcggccgccgcatgcagatcgaaaaagaccaggccaaaattatgagcggggtgcgccatgcacgtacactcggttcaccaattgctctcgtagttgaaaataacgattggaagcattggacaaaaatcatgggcgccgccccgattacagaagatgaagaaaaggaaatgaagcgccagatttccagacctagacctgggcacgctgacttaaacggtgcaattaaatataatcatcgtgatatgagaaatgtgcttgagcgttcttcagcaagggaaacaactgtcagagtggcggcaggggctgtagctaaaaagattctttctgagcttggcattaaggtggcgggccacgtgttgcaaattggcgctgttaaagctgaaaaaacagaatatacgtcaattgaagacctgcagcgcgtaacggaagagtctcctgtcagatgctacgatgaagaggcaggcaaaaaaatgatggctgccattgatgaagcaaaggcaaacggagattccatcggcggaatagtagaagtcattgtcgagggaatgccggtaggcgtgggcagctatgtccattatgaccgcaaactggatagcaagcttgctgccgctgtactgtcaattaatgcatttaaaggtgtggaattcgggatcggatttgaggcggcaggccgaaatggaagcgaagtccatgacgagatcatttgggacgaggaaaaaggatacacccgtgctactaacagacttggcggactggaaggcggcatgacgacagggatgccaatcgttgtccgcggagtcatgaagccgattccgactttgtataaaccgctgaaaagtgtcgatattgaaacgaaagaaccgttttccgccagcattgaacgttcagacagctgtgctgttcctgcggcaagtgtagtcgctgaagcggctgtcgcttgggaaattgcgaacgcagtcgttgaacaattcggattagatcaaattgaccgcattagagaaaatgtggagaatatgagaaaactgtcgagggaattttaatgaagacactgcatgttcaaactgcttcctcgtcatatcctgtttttatcggacaaggtatcagaaaaaaggcttgcgaactattaacctctttaaacaggcctttaacaaggattatgcttgtcacggatgaagaagtggaccgcctgtatggtgatgaaatgctccatttgctgcaagataaatggcctgtgaaaaaagtgacggtaccgagtggagagcaggcaaaatccatggacatgtacacaaaattgcagagtgaagcgattcgttttcatttggatcgctcctcatgcatcatcgcattcggtggcggtgttgtaggggatcttgccggttttgtggctgccacttttatgcgcggcattgatttcatccaaatgcctacgacgctcttggcgcatgacagcgcagtcggaggaaaagtagccgtgaaccatccgcttggaaaaaatctaatcggtgcgttttatcagccgaaagccgtgctctatgatacagatttcctgcgttctctgcctgaaaaagagcttaggtccggaatggcagaagtgattaaacacgcttttatctatgacagagcgtttctggaggagctgctgaatatccactcactgcgtgatatcactaatgatcagctgaatgacatgatttttaaaggcatttcaattaaagcgtctgtcgttcagcaggatgaaaaagaagaggggataagagcttacttaaacttcgggcatacgctcggtcatgccgttgaggcggaatatggatacgggcagatcactcacggtgatgccgtagccctcggaatgcagtttgctttatatataagcgaaaagactgtaggctgtgaaatggacagaaaacgtttggtcagctggctaaaaagcctgggttatccaagtcaaatcagaaaagagacggaaacttcggttctcttggaccgtatgatgaatgataagaaaacccgtggcgggaagattcagtttattgtgctcaatgaattagggaaagttgctgatcatacattttccagaaatgaacttgagagctggctgaacaaatggcgattggaggagacatcatgatgattcgcggaattcgcggagcaactacagttgaacgggatactgaagaagaaattttacaaaaaacaaaacagctgttagagaaaatcatagaagaaaatcatacaaaaccggaagatgttgttcaaatgcttctgtcggctacacctgatttgcacgctgttttcccggcaaaagctgttcgcgagctttcaggatggcagtatgtaccggtaacatgtatgcaggaaatggacgtaacaggcggtctgaaaaagtgcataagagtcatgatgacggtccagacagatgtccctcaggatcagatcagacatgtatatttagaaaaagccgtcgtattgaggcccgatttatcattgacaaaaaatactgaattgtaatacgataagaacagcttagaaatacacaagagtgtgtataaagcaattagaatgagttgagttagagaatagggtagcagagaatgagtttagttgagctgagacattatgtttattctacccaaaagaagtctttcttttgggtttatttgttatatagtattttatcctctcatgccatcttctcattctccttgccataaggagtgagagcaatgaatttccaatcaaacatttccgcatttttagaggacagcttgtcccaccacacgataccgattgtggagaccttcacagtcgatacactgacacccattcaaatgatagagaagcttgacagggagattacgtatcttcttgaaagcaaggacgatacatccacttggtccagatattcatttatcggcctgaatccatttctcacaattaaagaagagcagggccgtttttcggccgctgatcaggacagcaaatctctttacacaggaaatgaactaaaagaagtgctgaactggatgaataccacatacaaaatcaaaacacctcagcttggcattccttttgtcggcggagctgtcgggtacttaagctatgatatgatcccgctgattgagccttctgttccttcgcatacaaaagaaacagacatggaaaagtgcatgctgtttgtttgccggacattaattgcgtatgatcatgaaaccaaaaacgtccactttatccaatatgcaaggctcactggagaggaaacagaaaacgaaaaaatggatgtattccatcaaaatcatctggagctccaaaatctcatcgaaaaaatgatggaccaaaaaaacataaaagagctgtttctctctgctgattcatacaagacacccagctttgagacggtatcttctaattatgaaaaatcggcttttatggctgatgtagaaaaaatcaaaagctatataaaagcaggcgatatcttccagggtgttttatcacaaaaatttgaggtgccgataaaagcagatgcttttgagttataccgagtgcttaggatcgtcaatccttcgccgtatatgtattatatgaaactgctagacagagaaatagtcggcagctctccggaacggttaatacacgttcaagacgggcacttagaaatccatccgattgccggtacgagaaaacgcggtgcagacaaagctgaagatgagagactgaaggttgagctcatgaaggatgaaaaagaaaaagcggagcattacatgctcgttgatcttgcccgaaacgatatcggcagagtagcagagtatggttcagtttctgtgccggagttcacaaaaattgtttccttttcacatgtcatgcacattatctcggtggttacaggccgattgaaaaaaggggttcatcctgtcgatgcactgatgtctgctttcccggcggggactttaacaggcgcacccaaaatccgtgccatgcagcttttgcaagagctcgagccaacaccgagagagacatacggaggatgtattgcctacattgggtttgacgggaatatcgactcttgtattacgattcgcacgatgagtgtaaagaacggcgttgcatcgatacaggcaggtgctggcattgttgctgattctgttccggaagccgaatacgaagaaagctgtaataaagccggtgcgctgctgaaaacgattcatattgcagaagacatgtttcatagcaaggaggataaagctgatgaacagatttctacaattgtgcgttgacggaaaaacccttactgccggtgaggctgaaacgctgatgaatatgatgatggcagcggaaatgactccttctgaaatgggtggtatattgtcaattcttgctcatcggggggagacgccagaagagcttgcgggttttgtgaaggcaatgcgggcacacgctcttacagtcgatggacttcctgattttgttgatacatgcggaacagggggagacggtatttccacttttaatatctcaacggcctcggcaattgttgcctcggcagctggcgcgaaaatcgctaagcatggcaatcgctctgtctcttctaaaagcggaagcgctgatgttttagaggagctagaggtttctattcaaaccactcccgaaaaggtcaaaagcagcattgaaacaaacaacatgggatttctttttgcgccgctttactattcgtctatgaaacatgtagcaggtactagaaaagagctaggtttcagaacggtatttaatctgcttgggccgctcagcaatcctttacaggcgaagcgtcaggtgattggggtctattctgttgaaaaagctggactgatggcaagcgcactggagacgtttcagccgaagcacgttatgtttgtatcaagccgtgacggtttagatgagctttcaattacagcaccgaccgacgtgattgaattaaaggacggagagcgccgggaatataccgtttcacccgaagatttcggtttcacaaatggcagacttgaagatttacaggtgcagtcaccgaaagagagcgcctatctcattcagaatatttttgaaaataaaagcagcagttccgctttatctattacggcttttaatgcgggagctgcgatttacacggcgggaattaccgcctcactgaaggaaggaacggagctggcgttagagacgattacaagcggaggcgctgccgcgcagcttgaacgactaaagcagaaagaggaagagatctatgcttgaaaaaatcatcaaacaaaagaaagaagaagtgaaaacactggttttgccggtagagcagcctttcgagaaacgttcatttaaggaggcgctggcaagcccgaatcggtttatcgggttgattgccgaagtgaagaaagcatcgccgtcaaaagggcttattaaagaggattttgtgcctgttcagattgcaaaagactatgaagctgcgaaggcagatgcgatttctgttttaacagacaccccgttttttcaaggggaaaacagctatttatcagacgtaaagcgtgctgtttcgattcctgtacttagaaaagattttattattgattctcttcaagtagaggaatcaagaagaatcggagcggatgccatattgttaatcggcgaggtgcttgatcccttacaccttcatgaattatatcttgaagcaggtgaaaaggggatggacgtgttagtggaggttcatgatgcatcaacgctagaacaaatattgaaagtgttcacacccgacattctcggcgtaaataatcgaaacctaaaaacgtttgaaacatccgtaaagcagacagaacaaatcgcatctctcgttccgaaagaatccttgcttgtcagcgaaagcggaatcggttctttagaacatttaacatttgtcaatgaacatggggcgcgagctgtacttatcggtgaatcattgatgagacaaacttctcagcgtaaagcaatccatgctttgtttagggagtgaggttgtgaagaaaccggcattaaaatattgcggtattcggtcactaaaggatttgcagcttgcggcggaatcacaggctgattacctaggatttatttttgctgaaagcaaacgaaaagtatctccgcaagatgtgaaaaaatggctgaaccaagttcgtgtcgaaaaacaggttgcaggtgtttttgttaatgaatcaatagagacgatgtcacgtgttgccaagagcttgaagctcgacgtcattcagcttcacggtgatgaaaaaccgacggatgctgctgttcttcgcaagctgacacgctgtgaaatatggaaggcgcttcaccatcaagataacacaactcaagaaatagcccgctttaaagatcatgttgacggctttgtgattgattcatctgtaaaagggtctagaggcggaactggtgttgcattttcttgggaatgtgtgccggaatatcagcaggcggctattggtaaacgctgctttatcgctggcggcgtgaatccggatagcatcacaggcctattgaaatggcagccggcaggaattgaccttgccagcggaattgaaaaaaacggacaaaaagatcagaatctgatgaggcttttagaagaaaggatgaaccgatatgtatccatatccgaatgaaataggcagatacggtgattttggcggaaagtttgttccggaaacactcatgcagccgttagatgaaatagaaatagcatttaaacaaatcaaggatgatcctgcttttcgtgaagaatattataagctgttaaaggactattccggccggccgactgcattaacatacgctgatcgagtcactgaatacttaggcggcgcgaaaatctatttgaaacgagaagatttaaaccatacaggttctcataaaatcaataatgcgctaggtcaagcgctgcttgctaaaaaaatgggcaaaacgaaaatcattgctgaaaccggtgccggccagcatggtgttgccgctgcaacagttgcagccaaattcggcttttcctgtactgtgtttatgggtgaagaggatgttgcccgccagtctctgaacgttttccgcatgaagcttcttggagcggaggtagtgcctgtaacaagcggaaacggaacattgaaggatgccacaaatgaggcgatccggtactgggttcagcattgtgaggatcacttttatatgattggatcagttgtcggcccgcatccttatccgcaagtggtccgtgaatttcaaaaaatgatcggagaggaagcgaaggatcagttgaaacgtattgaaggcactctgcctgataaagtagtggcatgtgtaggcggaggaagcaatgcgatgggtatgtttcaggcatttttaaatgaagatgttgaactgatcggcgctgaagcagcaggaaaaggaattgatacacctcttcatgccgccactatttcgaaaggaaccgtaggggttattcacggttcattgacttatctcattcaggatgagttcgggcaaattattgagccctactctatttcagccggtctcgactatcctggaatcggtccggagcatgcatatttgcataaaagcggccgtgtcacttatgacagtatcactgatgaagaagcggtggatgcattaaagcttttgtcagaaaaagaggggattttgccggcaatcgaatctgcccatgcgttagcgaaagcattcaaactcgccaaaggaatggatcgcggtcaactcattctcgtctgtttatcaggccggggagacaaggatgtcaacacattaatgaatgtattggaagaagaggtgaaagcccatgtttaaattggatcttcaaccatcagaaaaattgtttatcccgtttattacagcgggcgatccagttcctgaggtttcgattgaactggcgaagtcactccaaaaagcaggcgccacagcattggagcttggtgttgcatactctgacccgcttgcagacggtccggtgatccagagggcttcaaagcgggcgcttgatcaaggaatgaatatcgtaaaggcaatcgaattaggcggagaaatgaaaaaaaacggagtgaatattccgattatcctctttacgtattataatcctgtgttacaattgaacaaagaatactttttcgctttactgcgggaaaatcatattgacggtctgcttgttccggatctgccactagaagaaagcaacagccttcaagaggaatgtaaaagccatgaggtgacgtatatttctttggttgcgccgacaagcgaaagccgtttgaaaaccattattgaacaagccgagggcttcgtctactgtgtgtcttctctgggtgtgaccggtgtccgcaatgagttcaattcatccgtgtacccgttcattcggacagtgaagaatctcagcactgttccggtcgctgtagggttcggtatatcaaaccgtgaacaggtcataaagatgaatgaaattagtgacggtgtcgtagtgggaagtgcgctcgtcagaaaaatagaagaattaaaggaccggctcatcagcgctgaaacgagaaatcaggcgctgcaggagtttgaggattatgcaatggcgtttagcggcttgtacagtttaaaatgaggtgactgatttgcgtatcaaagaacatttaaaacagctgaagccttatcagcctggaaagccgattgaagcagtgaaatcagaatatggcttggataaagttgtgaagcttgcttcaaacgagaatccttacggctgttcagaggctgcaaaagaggcgcttcatcatgagattcaacagctagccctttacccggacgggtatagcgccgctttgcggacaaggctcagtaagcacctcaatgtcagcgaaacatcacttattttcggcaacggttctgatgaaatcattcagatcatctgccgggcatttctaaacaataaaaccaatacgatcactgctgccccgacttttccgcaatataaacataatgcggttattgaaggtgctgaagtgcgtgaaattgcacttcgtcccgacggctcacatgatttagacgccatgttagaagccatcgacgaacagacacaagtcgtttggatatgcagcccgaataatccgactggcacttatacatctgaaggagaattactcgcatttctggagcgcgttccttcacgtgtccttgttgttcttgacgaagcatattatgaatatgtaacagcagaggattacccggaaaccgtgccgctcttaagcaagtattccaatttgatgattttgcgcacattttcaaaggcatacggtctggcagcgctcagagtcggatacggaattgctgacgagaacctgattcgccagattgagccggcgagagagccgtttaatacgagccgtctgggccaggctgcggcgattgccgctcttgatgatcaagcgtttattgcttcctgtatcgagcaaaataatgcaggccttcagcagtattatgattttgcgaaaactcatggtttaaagtgctacccttcacagacaaattttgtgttaattgactttaaacgtcctgctgatgaactgtttcaggctctgctggaaaaaggctatatcgtccggtcaggaaatgcattaggtttcccgacatcactccggattacgatcggaacaaaagagcaaaatgaagaaatacttgcaattttagctgaaattttataagaggtgatcaaatatcacctctttagtctataaaccaggtgatgacgtatgaatcaaatgaaagatacaatattgcttgccggtctcggattgataggcggttcgattgccctagcgatcaaaaaaaatcatcccggcaaacggattatcggaatcgacatctctgatgaacaggcggtagcggcattaaaattaggtgtgatagacgatcgtgctgattcgtttattagcggtgcgaaagaggcagctacagtaatcattgcgacacctgtcgaacaaacactggttatgcttgaagagctggctcattcaggaattgaacatgagcttttgattacggatgtaggaagcacaaagcaaaaagtggttgattacgctgatcaagtgctgcctagccgctatcaatttgtcggagggcatccgatggcgggttcacataaatcaggagtggccgctgcgaaggagttcctgtttgaaaatgcattttatattttaaccccaggccagaaaacggacaaacaagctgtggaacagttaaaaaacctgctgaaggggacgaatgcccattttgtggaaatgtcgccggaggagcatgatggcgttacaagtgtaatcagtcattttccgcatattgtagcagccagtcttgttcaccaaacccatcattcggaaaacctgtatccgcttgttaagcgttttgctgccggcggattcagagatattacaaggattgcatcaagcagcccggcaatgtggcgggatattttattacataataaagataaaatcttagaccgttttgatgagtggattcgtgaaattgacaagatccgtacatatgtagaacaagaagatgcggaaaatctatttcgttattttaaaacagccaaggattatcgcgacgggctgccgcttcggcagaagggagcgatacctgcattttatgatttatatgtggatgtacccgatcatccgggtgtaatatccgagataacagcgatcttagctgcggagcgcatcagtatcacgaatatccgcattatcgaaacacgagaggatattaacgggattttaaggatcagttttcagtctgatgacgaccgcaaaagggcagaacaatgcattgaagcccgggcggaatatgaaactttttatgctgattgaggtggaaaaatgaaacgagaaaaggtgcagaccttacatggagaaatacatattcccggtgataaatccatttctcaccgctctgttatgtttggcgcgctagcggcaggcacaacaacagttaaaaactttctgccgggagcagattgtctgagcacgatcgattgctttagaaaaatgggtgttcacattgagcaaagcggcagcgatgtcgtgattcacggaaaaggaatcgatgccctgaaagagccagaaagccttttagatgtcggaaattcaggtacaaccattcgcctgatgctcggaatattggcgggccgtcctttttacagcgcggtagccggagatgagagcattgcgaagcgcccaatgaagcgtgtgactgagcctttgaaaaaaatgggggctaaaatcgacggcagagccggcggagagtttacaccgctgtcagtgagcggcgcttcattaaaaggaattgattatgtatcacctgttgcaagcgcgcaaattaaatctgctgttttgctggccggattacaggctgagggcacaacaactgtcacagagccccataaatctcgggaccacactgagcggatgctttctgcttttggcgttaagctttctgaagatcaaacgagtgtttccattgctggtggccagaaactgacagctgctgatatttttgttcctggagacatttcttcagccgcgtttttccttgctgctggcgcgatggttccaaacagcagaattgtattgaaaaacgtaggtttaaatccgactcggacaggtattattgacgtccttcaaaacatgggggcaaaacttgaaatcaaaccatctgctgatagcggtgcagagccttatggagatttgattatagaaacgtcatctctaaaagcagttgaaatcggaggagatatcattccgcgtttaattgatgagatccctatcatcgcgcttcttgcgactcaggcggaaggaactaccgttattaaggacgcggcagagctaaaagtgaaagaaacaaaccgtattgatactgttgtttctgagcttcgcaagctgggtgctgaaattgaaccgacagcagatggaatgaaggtttatggtaaacaaacgttgaaaggcggcgcggcagtgtccagccacggagatcatcggatcggaatgatgcttggtattgcttcctgtataacggaggagccgattgaaatcgagcacacggatgccattcacgtttcttatccaaccttcttcgagcatttaaataagctttcgaaaaaatcctgaagttttacttcaggattttttatgcagatcataattcgaggcgaaaaaacatagcttgtcttatagaggggatagaaaaacaaaaaggggggatgtgctttacttacaagccggcaggtcaaagagctgctttactgtacagagggcgatcttccttttttcattttctatctcaagatcttttggtaaactaataagactcaataattcccttccgtacagaagcatcttatttgccgggggcattcgtctgaattatgataagattaacccgaacaaataaagcttttttgtatggttgatgttgtataggaaaagaaaggaccggtccgatttgaatacattgattcaagaagccataaaattagttgaagcaggtgaaacagaaaaaggcctcaacacgctctcgaaggctgaaaaacagctgcatgatgaagataaagccattgcagcccagctttattacgagtggggcgatgtagaaaaagccatttcactgattagtgatctacatgatttatatccaaatgaaacagaactgacgaatttctacgctgaacttttaatagatattgacgaagaagaaaaagccctcgctgtgctggagactattccggaaacagatccatcatatccggaaagtttgctgcttatggcggatctttatcagatgcaggggttattcgaagtcagtgaacaaaagcttttacaggcaaagtccattctggacaatgaacctgttattgattttgcactgggagaactttactttgctcagggagcctatgcaaaagcggttcaatattttaaatcaacggctgaggagcagagtgagatcggaggcgttaatgtccatcaaagactggcagaatcgttaagtgcctcaggtgaatttgaggatgccattccatggtatgagaaagctgtcgatgagaatcctgatcctaatacgattttcggctatggttttacagccttacaggcggggcttgtgaaaacagctgttaagcagctgtctgatttaaaggagcttgatccatcttatacttcactttatatgccgctctcgaaaagctatgaagctgaaggaatgtatgaagaggcattaaaaacggcaaaagaggggatcagatatgatgaatataacaaagaacttttcctttatgccgccaaaatggccttaaaaatcgggaagtcagaagaggggaaaaagctgcttcaggaggcgcttgcgcttgatccgggctttgtcgaggcgcttcatacacttcttgccgtgtatcacaaagaagaggattatgatcagatcattgatcttattcaagaggttcgaagctacggtgaagaagatccgaaatacaattggtatcttgcaagcgcatatactgaattagagcaatacgaggaagcaaaacaatcctttgaggctgcctatcttcattaccgggaggatagagatttcttatatgaatacgcaagcttcctattagaagaaggccttcaaaaagaagcgctgccgcttttgaaaaaggttcttgaaatggacggagccaatgaagagcttgaagaaacgattttgcgaatcgaggatgaattttctagataagcaggaatattaaccattcatgtggaacatataagtatatagattatacgaacgatagaggagggaattacatgcagacccctgtttctgtcaatgagaaaaaagattttatccgttggtttttaaaccattatcagttaaagcgccgagagtgcgtttggatcttgaactacttaatgagccatgattctctcatggagaaggttcattttgtggagcaggctgaattttgcccgagaggcattataatgtcaacacattgtgttgaagaagttccgttccggttctataaagagaatgtcatgactaccgacgcggaaaaatcttttcatgatattagattaaataaacagcaggatttgtttatccagcttaatttccgttcggcttacagctcacctgaatatgcggcggtgctggagtccaacccgcatattccgaaagatctttttgagaataaaaaagatcagggattggcggaacagattttagagcacgctatttccacattccaaagagaaaaattattaaaagacattgacgacgcgttagatcgtcatgataaagaggcatttgaacaattatcgcgccaattaaatcagctcacataatatgaccagccttgcagtgaattgcaaggcttgttgccgtaaagggggagaacgatgaggtggagaatcactgatgccaaggactatttacaagctaaggattacattgataccgctgtcataccattaattaacataagggttaataaccattttaaaatggcggcggagaaaggcgagtttacgcagcttctctcagaagaacttgaaaggcagttaaagggacgggtatatttacttccgccttatacatatgttgatagaaatgaaataaccgttcaagggcttaaggatttgcgggaagagctgataacggaatttccgcatgttgtcctgctcacatctgacgaaagttggagagctgaggatgcgttaggcaaaatgattgttacaccgtctgttccattagagcatttaaatgactctttaaaaagaaaaatattggatgaacgcactgctgaaattttgaacgttttgttacagttatggagcacttcataaaaacacttacatttccttatgaacaatattttggctatattgaccttgctgagagattcatatattatgagggtgtctagagttattgcaatattttctattttagtcagtttgcaggggtgacctagagaggggagaagagatgggcggaaaacatgatatatccagacgtcaatttttgaattacacgctcacaggcgtaggaggttttatggcggctagtatgctcatgcctatggttcgcttcgcactcgacccggtattaaaatcgacagggaagcaggatatggttcaggttgtcagcgttgatgagttgacaaaagagccgcagcgctttgattttaaaattaatcaagtcgatgcctggtatgagtcagaagagtcaagatcagcctgggtcttcaaaaacggggatgaaattgtagcactttcgccaatttgtaaacatttagggtgtacggtgaactggaatagtgatcctaaaaacccgaataaattcttttgtccatgccattacggactctatgaaaaggacggcaccaatgtccctggcacgccgccgcttgcgcctcttgatcattatgagcaagaagtaaaagacggcttcctgtatcttggaaaagcaaagcctaagggggaagggtgacatgctgaacaaaatttatgactgggtagacgagcggcttgatattacaccgatgtggagggatattgccgatcacgaagtaccggaacatgtgaatcccgcccatcatttctctgcgtttgtgtattgctttgggggactgacgttttttgtaaccgttatccaagtattatctggaatgtttttaacgatgtattatgtgcctgatatcaaaaatgcctgggaatcggtatattatttgcaaaatgaagtggcattcggccagattgtcagggggatgcaccactggggtgcgagcctggtcattgtgatgatgtttttacatacgctgagggtctttttccaaggcgcgtataaaaaaccgcgcgagctgaactggattgtcggtgtgctgatcttttttgttatgctcggtcttggctttacaggctacttgcttccttgggatatgaaggctctgtttgcaacaaaagtcgggctgcagatcgccgaagccacgcctttgatcggaacgcaagttaaaacgctccttgcagggcatccggatattgtaggcgcccaaacgctgactaggttttttgcgatccatgtattttttcttcctgccgcattgttcgggctgatggctgcacattttattatgatccggaagcaggggatttcaggaccgctttaaactcttgatctgcgaataaaagggaggggatgacatgcaccggggcaaagggatgaaatttgtaggcgactcaaggataccggctgaaaaaaagccgaatataccgaaggattattcggagtatcccggtaaaacagaggctttctggccaaatttcttgttaaaggaatggatggttggagctgtctttctcatcggttttctcgttttgacgattgtgcatcagccgcctttggagcggatggcggacccgactgatactggttatattccgctgccggattggtattttcttttcttataccagctgttgaaatatgaatacgccgctggaagctttacagtggtcggcgccatgattatgccaggtctcgcttttggggccctgctattggctccattcctagacagagggacagaaagaaggccgtggaagcgtccggtcgctgtcggtatgatgcttctggccatttccgctgctgtatttttgacgtggcagtcagttgctactcatgactgggccaaggcagaagaacaggggaaaattacaaaagaagccgacattgacaccaatgcagaaggatataaggtttttaaggaacagggctgtatttcttgccatggggataaccttcagggaggagcggccgggccttcattggttgacagcgggctgaaaccggatgaaatcaaaaaaatagctgtagaagggaaaggcaaaatgccggcgggtgtgttcaaaggaaatgataagcaactcgaagaacttgcaaaatttatttctgaaacaaccgcaaaataacgtattgtgaattgtcaaatggaaggatatacttttattatcaaaagctgacccggcgtcagcttttttatatggacatattatttttacagactgagagttgattcgatgtgaaatggtttcaatatgtattagggcagcggccgatgcttattcttgtcttagccattaattttctgggaacggtttacggctactattggtacttgccgcagcttttggagacaccggcccgtttcctgatttttgttccggacagtccgacagcaacgtttttctttctgtttgtgctgcttgcctttctcatgaaacggaatgctccgttctttgaggcgcttgccctagttaccctcgtaaagtatggcctatgggcggtggctatgaattttcttgtgcttgcagtaactggtgacttgccgtgggagggctacatgctaattgcttcgcattttgcaatggctgttcaaggcgtattatacagtccgtattttcgtttttcattttggcatcttgcaattgctgcagtctggacactgcataacgatgtcattgactacttgtttgatatgatgccgcggtattcaatgctttctgattatatggctgaaataggatacggaacattttggctaagcatcttctcaatcgcgcttgcttactttcttgtggtctcaaaaaagcaaacgaagcttgagctgatgtaaagacaatgttggtctatccttgtccctttcttcatattctgtaaggagagagagtgggagggacctgcatgaaacgaaagctgacgatctgtttgttgattgcacttattttttataatggaaatgccaaggctgcagagcggggaagcctcgaggaattgaatgatttatccgatacagtctttcaaatgacccgacaggcgaaatatgaagaggcgcttcaagtcttggagtattttgaaaaaacattaaaatccgctgagaaaaaacagcaagaccccatgctaacgggagcccaaattcgtcaaatcacattgggctataatgatatggttcggagtttaaagcaagctgatacatcagacacacaaaaactcagagcagccgcgcagttcaggatgctgatggatgcggttgacaatcggtctgacccgctttggggctcactggaaaaaccgattatggaagcttttactgagctgaagcgagatgtccaaaagaatggaagcacaagctttcatgaaaaatggaatgaatttatcagtttatatgacttgatttaccccagtcttacaatcgatgtatcagaggatcagcttgaaacagtcggaaaacatatagacgtcattgagcaagaggaatttcagcaaatgacagagagcacgaagcttgaacggctttcccttcttcagcatgacctgaaaaatgtgtttgacagggtggaggaggatgatgccgatccgtctttactctgggtgatgattacaaccggcagtatcatcattactgctcttacctatgtcggttacagaaagtacaaggcggaaaaaaacaagctgaaaaaaagggactaccctaaataaggatgaggggcggcggtcagccgccttttttctattacatgtcagcgcggaagcggatttttattttcatcaagcgtaaatccttctccgagcacatcgtgaacatcgcttaccgctacaaaggcatggggatcaatggagttaatcacgcttttcagcatcaccaattcgtttttcggcaccacacaataaagtacatctatatcctcttttgtgtaggaaccttgtcctttcaaaatggtgacgcctcgttccatttcttcaagaatctttttctgaatcaggtcgtttttcgaagagatgatcgtagcgcctttagcagcgtatccgccttcctgaataaaatcgattaatcttgccgctacaaatacagctaccagcgtatacatcgcttctttataggagagataagtaagcaaagacaaaatgatgacgcaggcatcgaaagcaaacatcgttctgcccatcgggatcccaaaatacttattcactaaacgtgcgatgatatcaacaccgcctgtcgtaccgccgaacttaaaaataatacccagtccggctccgatgaatacgccggcaaataaagcggcgagcgctaagtcgtgctgaaggggcatatggatttcatatcgctgaaagatgctgaggaacaaagacaaggctacagtgccgacaagggtataaacaaacattgtcctgcccagcaaacgccagccaataaaaaaaatcggaatgttcaacaccaggttcgagatagaggggctgatgtggaaaagggcataaagcaaaagtgtaatacctgtaaaaccgccctcagccagattgttctgcatattgaaatgaaccaagccaaatgaaaaaattgccgctccgattaaaataaaaaatatgttttttaatctaatttctccaagcatcacacaaaaccccttttccttccattagatagcgtttatattatagtggatgaaaaagaaaacagcaaacgtgcttaaacatttgtcaaacgtatctgaattagctaacatgtaagaggatgataggaggtttcgttcagtgagtgataaaacaatgaaagacatacaggctgaagtagaccgttacatcggccaatttaaagaaggatatttcagcccgctggccatgatggcgaggctgactgaagaactgggcgagcttgccagagaagtgaatcaccgttatggagaaaaaccaaaaaaagcgactgaagatgataaaagcatggaagaggaaatgggcgatgtgctatttgtattggtttgtttagccaactcccttgatatctctttagaggaagcccacgaccgagtcatgcataaatttaatacaagagataaagatcgctggaccagaaaagaagaaggaaagtagaggagatcgagatgtcaaacgaaacaattaaagtagtcattgcgggaccgcgtggaagaatggggcaggaagctgttaaattggcagaacgaacacctcattttgaccttgtcggggccatagaccatacatacgatcagcaaaaattatctgatgtgatgcctgttgagtcagatgctttcatttacacagatatccatgcctgttttacagaaacacaaccggatgttttgattgatttaacaacgcccgaaatcggaaaagtacatacaaaaattgcattagagcacggagtccgtccagttgtcggaacaaccggtttctcagaagctgatttaaaagagctcacgtctttaacagaagaaaaagggatcggagccatcattgcgccaaattttgcgctcggtgcgatactgatgatgaaattttcaaaaatggctgccaactattttgaggatgttgagattattgagcttcatcatgaccagaagcttgacgcaccaagcggaactgcgcttaaaacagcggaattgatttcagaagtccgtaaagaaaagcagcaaggacatccggatgaaaaagaaattctcccaggagcaagaggagcggagcaaaacggcattcgcttgcacagcgtccgtcttccgggactgatcgcgcatcaggaggtcatgttcggcatggatggccaaacgcttcagatacgccatgattcttataaccgtgcttctttcatgtcaggcgttaaactgtcagtcgaacaagtcatgaagattgatcagcttgtgtacggtttagaaaatatcattgattagacggggggataaacaatgaaaattgctttgatcgcgcatgacaagaaaaaacaggatatggttcaatttacgactgcctatcgggatattttaaagaatcatgatctatacgcaaccggaaccacagggttgaaaattcaagaggcgacaggtcttcaaattgaacgttttcaatccggccctttagggggagaccagcaaatcggtgcactgatcgctgccaatgcactcgatcttgtcatttttttgcgcgacccgctgaccgcgcagccgcatgaaccggatgtctcggcattaatccggttatgtgatgtgtattccattccgctcgccacaaatatgggtactgcggaaattcttgtccgcacacttgatgaaggtgttttcgaattccgtgaccttcttcggggagaagagccgaatgtataatgctgacgttcttgcttttggcgcccacagtgatgatgtcgagatcggaatgggcggcacaatagcgaagtttgtcaaacagggaaaaaaagtaatgatatgcgacttgacagaagcggaactctcttctaacggtacggtcagtttacgtaaagaagaagcagctgaagcagcccgcatattaggcgcagataaaagaattcagctgacgcttccagaccgcggcctaataatgagtgatcaggcaattcggtcgattgtcactgtcatcagaacctgtcggccaaaagcggtttttatgccgtataaaaaggatcgccatccggatcacggcaatgcggctgcactggtggaagaagcgatcttttccgccggaatccataaatataaagacgaaaaaagccttccggcgcataaagtcagcaaggtttactattatatgataaatggttttcatcagccggattttgttattgatatctcggatacaatagaggcaaagaaacaaagcctcaacgcctacaaaagccagtttatcccgtcaaaggattccgtttctactcctctgacgaatgggtatattgaaatcgttgaagcgagagaaaagctttacggtaaagaagcgggcgtggagtatgccgaaggtttcttttcaaaacggatgctgttgcttgatcatgatgtgcttgggggcgaacaatgagaaaactaaaaataggaatcacatgctatccgagcgttggaggctcaggtatcattgcgacagaactggggaagcagcttgctgaaaagggacatgaaatccatttcatcacatcaagcattccgtttagactgaatacatatcatcccaatattcattttcatgaagttgaggttaatcaatatgctgtttttaagtatcctccgtatgatttgacattggcaagcaaaatcgcagaggtggcggaacgggagaatttagacattatccatgctcactatgctctcccgcatgccgtttgcgcctatcttgcaaaacaaatgctgaaacgcaatatcggcattgttaccactttgcatggtacggatatcacggtgttaggttatgatccgtctctaaaagatctgatccgttttgccattgagtcatcagacagggtgactgccgtctcctcagcgcttgcggctgaaacatacgatttaattaaaccggagaaaaaaattgaaacgatttataactttatagacgagcgtgtgtatctgaagaaaaacacagtggcaattaaagagaaacatggaattttaccagatgaaaaagtcgtcatccatgtgtccaacttcagaaaagttaaacgcgtgcaggatgtcatccgtgtgttccgcaatatcgctggcaaaacgaaagcgaagctgcttttagtcggagacggtccggagaaatcgacagcctgcgagcttatcagaaaatatggcttggaagaccaagtcttaatgcttggaaatcaagaccgtgttgaagagctttattctattagcgatttgaagctgctgctatctgaaaaagaaagcttcggtcttgtcctgcttgaagcgatggcttgcggagtgccttgtatcggaacaaacattggcggtatccctgaggttattaaaaacaatgtgagcggatttttggtggatgtcggtgatgttgcggctgcaacagcccgcgcgatgagcattttagaagatgaacagctaagcaatcgttttacaaaggcggcaatagagatgcttgaaaatgaattttcttccaaaaaaattgtcagccagtatgaacagatttatgccgatttagcagaaccggagtgatcacatggaaaaagtttttatcaaagcacttcccgtgctccgcatcttaatcgaagcaggccatcaggcttattttgtcgggggcgcagttcgtgacagctatatgaaacgagcgatcggagatgtcgatatcgcgacagatgcggcacctgatcaagtagaacgactgtttcagcggactgttgatgtaggcaaagagcacgggaccattattgtgctctgggaggatgaaacctatgaagtcacgacattccggactgaatctgattatgttgatttcagaagaccgtcagaagtgcaatttatctcatcattagaagaggatctaaaacgcagagatttaacgatcaatgcgatggccatgacagcggatgggaaggtgcttgattattttcgcggcaagaaagatattgatcagaaaatgattcgaaccgttggaaagcctgaggatagatttcaagaggatgcgcttcgtatgctgagagccgtacgctttatgagccagcttggctttacactttcaccggaaacagaagaagccattgcgaaagaaaaatcactcctctcccatgtttcagtcgaacgaaaaactatagagttcgagaaattgctgcagggaagagcttctcgccaggcgcttcaaacgctcattcaaacgagattgtatgaagagcttcctggtttttatcataaacgagaaaacctgatttcaacgagtgagtttccattcttctctttaacatcccgtgaggagctttgggctgctcttttaattaaccttggcatagtcttgaaagacgcgccccttttcctgaaagcctggaagctcccgggaaaagtgatcaaggaagccattcacattgctgatacgtttggccagagccttgacgcaatgacaatgtacagagctggggaaaaagcactgctctctgcggccaaaatatcgcagcttcggcaaaacgaaaaactggatgaaaagaaactgaaggacattcagtacgcttatcaaaacctgccgatcaaaagccttaaggatcttgatatcacgggtaaggacttgcttgcgcttcgaaaccgaccggctggaaaatgggtgtcggaagaattacagcggatcgagcaggctgttgtgacagggaagctctccaatcaaaagaaacacatagaggagtggctgaagacatgcggtcaacattaagaaaagaccttattgaattattttctcaggccggcaatgaatttatttccggccaaaaaatcagtgatgctctcggctgttcaagaactgctgtgtggaagcatattgaagagcttcggaaagagggttatgaagtagaagccgttagaagaaaaggatatcggctcatcaaaaagcccggaaaactcagtgaaagcgaaattcgttttggattaaaaacggaagtgatgggccagcatcttatttaccatgacgttctttcaagcacgcaaaaaacggctcatgagctcgcgaataataacgcaccggaaggcaccctcgtggtggctgacaaacaaacagccggaaggggccgaatgtctagggtttggcattctcaagaaggaaacggcgtttggatgagcctgattttgcggcctgacattccgctccaaaaaacaccgcagctgactctgcttgctgcagtagctgttgtgcagggaatagaagaggcagcaggcatccaaacggatattaaatggccaaatgatattttgattaacggaaaaaaaacagtcggtatcctaacggaaatgcaggctgaagaagaccgcgtacgttcagtgatcattgggattggcattaacgttaaccagcagcctaatgattttccagatgaattgaaggacatcgcgacaagcctcagccaagctgctggggaaaaaattgatcgggccggcgtcatccagcatattttactatgctttgagaaacggtaccgggattatatgacgcacggatttacgccgattaagcttttatgggaaagctatgcgctcggtattggcactaatatgagagccagaacgttaaacggaaccttttacggtaaggcgttaggtatagatgatgaaggcgttctgcttttagaaacgaacgagggcattaaaaaaatctattctgccgatatcgaattgggctaatgtgttggtacaagcccgttgattttggtatacttccattgggcagtatcgcctgcgaactgcacctattattaaaatagatagacattgcagcagtctgccttgatccaaaaaaggactgggacagagggatgaaactcgccgaactttagaaagtgaagaatccttctcgttgtaacggaaggttttttggcttgcagaagaaaacggcagatcatctcctctaaacatgaggaggagaaaacatgaaaacaaaactggattttctaaaaatgaaggagtctgaagaaccgattgtcatgctgaccgcttatgattatccggcagctaaacttgctgaacaagcgggagttgacatgattttagtcggtgattcactcggaatggtcgtcctcggccttgattcaactgtcggtgtgacagttgcggacatgattcatcatacaaaagccgttaaaaggggtgcgccgaatacctttattgtgacagatatgccgtttatgtcttatcacctgtccaaggaagatacgctgaaaaatgcagcggctatcgttcaggaaagcggagctgacgcactgaagcttgagggcggagaaggcgtgtttgaatccattcgcgcattgacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcggacggacaagttctcgtttatcatgatattatcggccacggtgttgagagaacacctaaatttgtaaagcaatatacgcgcattgatgaaaccatcgaaacagcaatcagcggatatgttcaggatgtaagacatcgtgctttccctgaacaaaagcattcctttcaaatgaaccagacagtgcttgacggcttgtacgggggaaaataagatgagacagattactgatattacacagctgaaagaagccataaaacaataccattcagagggcaagtcaatcggatttgttccgacgatggggtttctgcatgaggggcatttaaccttagcagacaaagcaagacaagaaaacgacgccgttattatgagtatttttgtgaatcctgcacaattcggccctaatgaagattttgaagcatatccgcgcgatattgagcgggatgcagctcttgcagaaaacgccggagttgatattctttttacgccagatgctaaggatatgtatcccggtgaaaagaatgtcacaattcatgtagaaagacgcacagacgtgttatgcgggcgctcaagagaaggacattttgacggggtcgcgatcgtactgacgaagcttttcaatctagtcaagccgactcgtgcctatttcggtttaaaagatgcgcagcaggtagctgttgttgatgggttaatcagtgacttcttcatggatattgaattggttcctgtcgatacggtcagagaggaagacggcttagccaaaagctctcgcaatgtatacttaacagctgaggaaagaaaagaagcgcctaagctgtatcgggcccttcaaacaagtgcggagctgatccaagccggtgaaagagatcctgaagcggtgataaaagctgcaaaagaaatcattgaaacgactagcggaaccatagactatgtagagctttattcctatccggaactcgagcctgtgaatgaaattgctggaaagatgattctcgctgttgcagttgctttttcaaaagcgcgtttaatagataatatcattattgatattcgagaaatggagagaatataatatgtatcgaacaatgatgagcggcaaacttcacagggcaactgttacggaagcaaacctgaactatgtgggaagcattacaattgatgaagatctcattgatgctgtgggaatgcttcctaatgaaaaagtacaaattgtgaataataataatggagcacgtcttgaaacgtatattattcctggtaaacggggaagcggcgtcatatgcttaaacggtgcagccgcacgccttgtgcaggaaggagataaggtcattattatttcctacaaaatgatgtctgatcaagaagcggcaagccatgagccgaaagtggctgttctgaatgatcaaaacaaaattgaacaaatgctggggaacgaaccagcccgtacaattttgtagaagaaaagccccctttatcgggggttttcttttaagattttgagagtaaaacggttttgccgctccatttccgtacaaaacgtgttacacttttgtcgtatgcaagaattgaggtgtccattttaatgaataagcaacggttcgttgttatagatgtagagacaacagggaattcgccgaagaaaggcgataaaatcatacaaatcgcagcggttgtaatcgaaaatggacaaattactgagcggttttcaaaatacattaatccaaataaatcaatccctgcttttattgagcagcttactggaatctctaatcaaatggtcgagaatgaacagacatttgaagcagttgctgaagaagtattccaattgcttgacggcgcttattttgtcgcacacaatatccattttgaccttggatttgtcaagtatgagctacataaggcgggctttcagctcccagattgtgaagtgcttgatactgtcgagctctcacgtattgtttttccgggatttgaagggtataagctgacggaattaagcgaggagcttcagctgcggcatgatcagccgcaccgggctgacagcgatgctgaagtgacagggcttatttttttggaaatccttgaaaagctgcggcagcttccttatccgacattaaagcagttaagaaggctttcgcagcatttcatcagtgatctgacgcatttgttggatatgttcattaatgaaaacagacataccgagataccgggctatacgcgcttttcttcgttttctgtcagagaacctgaagctatcgatgttcgtataaatgaggacgagaacttctcatttgagatcgaaagctgggaagcgggaaatgaaaaagcgctgtcagagttaatgcctgggtatgaaaaaagagacggccaaatgatgatgatgagagaggtggctgatgcgtttgccaatcgtgagcatgcgctgattgaagctcctccaggcatcggaaaaacgattggctatcttattccggctgcgctttttgccaagaaatcaaaaaagccggtcataatcagcacgtattcgacgcttttacagcagcagattctcacaaaggatttgccgattgtccaagatctgtttccatttccggtaacagcggcgattttaaaagggcaatcgcattatttatgcctgtataaatttgagcaggtgcttcatgaagaagatgataattatgatgccgtactgacaaaggcacagcttctcgtttggctgacagagacaaatacaggagatgtagcggaactgaatttgccttcaggcggaaaattgctgtgggacagattggcttatgacgatgactcctataaaagaagtcgcagtgagcatgtgatcggtttttacgagcgggccaaacagattgctatgcgttccgatttggtgatcaccaatcattctcttttgctgaccgatgaaggcagccagaaaaaaaggcttcccgaaagcggcacatttattattgatgaagcacaccattttgaacgtgcggcaagcgaacatttagggaaaagagccacgtacatagaattgcatacgaaattgagcagaatcggcactctgaaggagcagggacttctaaaaaagatgagacagctattccagcgaaacagcctgccggttgattcatttttcgaattggaagagtggcttcagcacgttcaagcagaaagtgatgctttcttcagctctgtacattcttttgtcaaacgaagaaaacctaaagaagacttaaaccgtctagtgtttaaggtgaacaaagaaagccaggataaaagctggtcgaacttaacagatggtgcggagaggctttgttccatgctgacacatttgcagcagctttttgaggcgcagtcatcccttatggaaaaacatttgaagggtatgaagagcaaaaccgtctttttagccgatgaataccaaagaagcatgaaaggcttgcagcattactgtcagacgttgcagaagctcttctttgggtctgatgacgatgaagcggtttggattgaaatagatgcaaagggtgcgaaaaatgcagtggccatttacgcacagcctcttgaacctggtgaacttctggctgatcagtttttcgcgcgcaaaaatagtgtggtgctgacatctgcaactcttacagtcgaaggttcttttcaatttatgattgaacgactgggactgagtgactttttcccgcggacaatgagaattgaatcacccttttcttacgatgagcgtatgcaggtgatgattccaaaggaaatgaaatcaattcaggatacaggacaacctgaatttatacaggatacagcccgttatatcgaactgatggcaaaggaaaaacagcctaaaattcttgtgctgtttacatcccatgatatgttgaaaaaggttcaccaggagctcaagcataacatgagtgcttccggcattcagctcttggcacaagggattacaggcggaagtcccggcaaactgatgaagacttttaaaacatccaatcaggcgatcctgctcggaacaaaccatttttgggaaggcgttgatttccctggtgatgagctgacaacagtaatgatcgtgaggctcccattccggtcccctgatcacccgcttcatgctgcaaaatgtgagtttgcccgcaaaaaaggaaagaatccgtttcaaacagtgtcattaccggaagctgtgctgaccttcaggcaaggaatcggacgcttgctgcgttctgcgggagacaagggaacgattattatattggacagacggattaaaaccgctggttacggccggctgtttcttgatgccttgccgacagcctcagtatccgaaatgactgacagcgagcttgaagcttatgttgcaggggaaaaagaataaaagccgcataaagcggcttttgcggtgtgggagtaggatggtgttttatttaaaagcggatttcccgctctgtgatactagtatggcgtgtcctgaaatggagtatgactaacaatatttgttcaaactggaggatgaaaaaatggaaagtaaaatcgaaattctttcaacaattaatgtagagcattctgatgatctgtataaaattgtggacacattgaatcgtacactgaaaagagacaatctgatgttcggccttgcgctggatgaagaaaacaaaaaccaagccgtttttaccatttatcgtacgtaggtgagaagatgagaaaaaaagcattaatatttaccgtcatttttggtattatttttttagcagtacttcttgtctcggcaagcatttataaatcagccatggcacaaaaggaagaggggcacgaagcagcagctgctgaagctaaaaaagaaaccgatctcgccaatgttgatcaagtcgaaacatttgtcggaaaagaaaaatattatgttgtaaagggaacggataaaaaaggcactgcattatatgtctgggttcctgctgataaaaaagcaaaaattctctcaaaagaagcgaaagagggaatctctgaagacaaagcggcgaaaatcataaaggatgaagggctggtttcaaagcaaaaagaggttcatctggcaagagaaggaaacgtcctgctttgggaagtgacgtacttagacaaagaagggcaatacagtttaagttatgtggactttacaactggaaagattctcaaaaatatcacgccttaagacgaattagggggagttcaagttgaaactggcaaaaagagtatccgcattaacaccatcaaccacactggcaatcacagcgaaagcgaaagaactgaaagccgcaggccatgatgtcatcggcttaggagcaggcgaacctgacttcaatacaccgcagcatattattgatgccgctgtgcgttcgatgaacgagggccatacgaaatacacgccttccggtggtttggctgaactgaaaaacagcattgcagagaaatttaaacgcgaccagaatattgaatacaaaccgtctcaaattattgtctgcactggtgccaaacatgctctgtatacccttttccaagtgattttggatgaagaagatgaagttattattccaacgccttactgggtaagctacccggagcaggtgaaactcgctggcggaaagcctgtttatgtagaagggcttgaggaaaatcacttcaaaatttcgcctgagcagctgaaaaatgcaattacggaaaaaacaaaagcaatcgttattaactctccaagcaacccgactggtgtcatgtatacggaagaagaactatctgcgctcggtgaagtgtgccttgaacatgatatcttgattgtgtcagatgaaatttatgaaaaacttacatacggcggaaagaaacatgtttccattgcacagctgtcagacagactgaaagagcaaacggtcattataaacggcgtatcgaagtcccacagcatgacaggctggagaatcggttatgcggcaggctctgaagacattattaaagcgatgacgaaccttgcaagccacagtacgtcaaacccgacatcaatcgcacaatacggagcgattgctgcttataacgggccttctgagccattggaagaaatgagagaagcatttgaacatagattaaatacgatctatgcaaagctcatagaaattccagggttcagctgtgtgaagccggaaggtgctttttacttgttcccaaatgcaaaagaggcagctcaatcttgcggtttcaaagatgtagatgaatttgttaaagcgcttctcgaggaggaaaaagttgcgattgttccaggatccggatttggctctcctgagaatgtccgtctttcttatgcaacatcgttagatcttcttgaaaaagccattaaaagaatcaagcgttttgtagaaaaacatagctaacagatcaaaaagcggctgccagaaaagccgctttttatctgcattgacccggttagttaagagcgggtataataaagtgatgataaaagagttcgcggggcaatgagcttccgaatgtctttcttgttttggagggaaatatgttgaaaacaacaatcaaccaagtgtacaagcacgtaggtgaggaagtaacgatcggagcttgggtcgctaataagcgttcaagcgggaaaattgcgtttttacagcttcgggacggtaccggttttattcagggtgtcgtagtaaaagcggaagtggaagaaagcattttccaaacagctaaatcagtgacgcaggaaacgtcgctctatataaaagggattgtcaaagaggacgagcgttctccgcttggatatgaacttgctgtgacagatattgaagtcattcacgaagcgaccgattatccaattacaccaaaagaacacggaacggaatttttgatggatcacagacatttatggctgcgttcaaagcgccagcatgcgatcatgaaaatccgtaatgaaatcattcgcgcgacttacgaattctttaataacgaaggcttcgtaaaagtggatccgccgattttgactggaagcgcacctgaaggtacaacagaactctttgcgacaaagtactttgatgaagatgcgtatctgtctcaaagcggccagctctacatggaagctgcggcaatggctttaggaaaagtattctctttcggaccgacattcagagcggaaaagtctaaaacaaagcgtcacttaatcgaattctggatgatcgaaccggaaatggcgtttgtagaatttgaagaaaaccttcaagtacaggaaaattacgtttctttcatcgtacaatcagttcttaagaattgtaaaattgaattaaacacattgggaagagacacgtcaaaacttgagcaaatcaaagccccgttcccaagaatcacgtatgatgaagcgattgaatttctgaaagaaaaaggctttgacgatatcgagtggggagatgatttcggagcgcctcatgaaacagcgattgctgaacattatgacaaaccggtattcatcactcgctatccgacgtccttaaaaccgttctatatgcagccggcttctgaccgtgaggacgttgtgctttgcgctgacttgattgcgccggaaggctatggagaaatcatcggcgggtctgaacggattcacgatatggaacttttggaatcgcgtcttaaagaacatggactggattctgacgcatataaatggtatgctgaacttagaaaatatggatcagttcctcattccggcttcggccttggattagagcggacagtagcttggatcagcggagcgcctcatgttcgtgaaacgattccgttcccaagactgttaaaccgtctgtatccgtaatacattcaaatgaaacaaaaaagagtctcctgcaagggagactttttacagtaaaggggcaatcacaatcctttacagtaagaggtgtgacgatgaaaaaacagcaatttattgatatgcaggagcagggaacatcaaccatccccaatcttctgcttacgcattataaacagcttgggcttaatgaaacagaacttattctgctgttaaaaattaaaatgcatttagaaaaaggatcatattttcctacaccgaatcagctgcaggaaggtatgtcaatttctgttgaagaatgcacaaacagattgcggatgtttattcaaaaaggctttctgtttattgaagaatgcgaggatcaaaacggcatcaaatttgagaaatattctcttcagcctttatgggggaaactgtacgagtatattcagcttgcacagaatcaaacacaggaaagaaaagcagaaggggaacaaaaaagcctttataccatttttgaggaagagttcgcaaggccgttatcgcctttggagtgtgaaacgctggcgatctggcaggaccaggatcagcatgacgcacaactgatcaaacacgcgttaaaagaggctgtactatcaggaaaactcagtttccgctacattgaccggattttgtttgaatggaagaaaaacgggcttaaaactgtggagcaggcaaaaatacacagccaaaaattccggcgtgtacaagcaaagcagaatgaaccgcaaaaagagtataaaaggcaggttcctttttacaattggcttgaacaataaagtgaaaaggtgacaatcgtgttaaatctaaaacaaattgaattctgtttagacaagataggtgacatgtttcctcatgcggagtgtgaactggttcattccaatccttttgaattagtggtggctgttgctttatctgcgcaatgtacagatgcacttgtaaacagagtgaccaaaacattattccaaaaatataaacggccggaagactatttggctgttccgctggaagagcttcagcaggatattaaatcaatcggtttatatcgtaataaagcgaaaaatattcaaaagctgagtaaaatgattattgaagattacggcggagaagtgccgagagaccgcgatgagcttgtcaaactgccaggggtcgggagaaagactgcaaacgtagtggtatccgttgcgtttggcgtgccggccattgccgtagatacccatgtggagagagtcagcaaacgattgggcatttgccggtggaaggactcggttctggaagttgaaaagacgctgatgcgcaaggttcccaaagaagactggtccgttacgcatcaccggcttattttcttcggcagatatcactgtaaagcccaatctccgcgctgtgcggagtgtccgctgctttctttgtgcagagaagggcagaagagggataaaaaaggactggtgaaacgatgacgcaagcaaaagaagtgttggcttcctatgagcaatacttgcgcagtcttgaccagaagagttcctcggatatgaagaaaaccttactgaccaatccagtgtattttgatttctgcacggaactacaaggcgatttgccatgggaggacagcgggaaatacgttccgcttttatttgaagtgtgggatgacatcaaagcatcacttcttccagtctttcaaacacgaaaatcgagatgtgaccaaaacgaaatgttaaagggcattgtgtgtttgctggcttcgttacattggacagcaggtgagccggtgaaatcgctcgattggcaagaactgagggagaaatcatatcccgcaaagccgattaattgggctgaacgagtggaatttattcttcttaagccgacccaataccattgctttattcagcttgacgagctgattaccgaaatgaaaaagcatttttataaatatcatgcgatgaatcgataaaacctcctgttaaaacgggaggttttttattgtgtaccaaaaaagccatcaccccaaaggtgacggcttttttggttaatttgttttttcaattgatgatgagtttgtttgtgttttattagatgtgtctgttttatttttattcgtgtcagaacctgttgaatcattcttaccagagttcgaatcaccatccgacgtatcctggttgttactgttgtcgttatcgttattgtttgattggtcttggttattgttgtcgggcggattggtgttcgtattgtcttgttttttgtcttgatcgtttgttgaatcatctgtctgatcttgatccgtctgaccgtcatctttttgagaatcatcagtttgtgtatcatcctgagtcttctcatcatcttgtttttcatcatccgtttgttgctggtcttttttatcttcatcgtcttcagcttttggcacctcataggatgtggaagctgtacttttgccatcatcactgacggctgttacttcgaatttgtacacagaacctggctgcacacccgaaatgactgcctcttttgcagagctgttttgaatttctgagtagctgccgccatcaacagattgcttaactgcaaaggtcgcatctccgtcgtaattccagcttaacgttaaagattgattgtctttatcgtatttcacgtttaaaccagacagtttagctgtttcctctttttcttcttgctcatatgttttagaaacagtagaaggagctgtacctttaacaaagtactctgtgagcttcttatcgcttggcgtatttggccctgccagttttgccggattagaacctttttctacggtggcttccactacgctgtcaggcttctcaaatgatccgcttccgtcatcgacatcggcgatgagctgggcgaagatgcgctttgcaactttttgctcttcagctgaaagtgatttctttccagcctcgttttctcccattcccgtccagacggcagctgtatattgcggtgtgtagccaacgaaccaagaatctcgggcgccaccgctagcgatattgtaccttttgacttcattatcatcaaagttagtcgttcctgtttttcctgcaacttctacaccaggtacttgtgcaagctgtccagtacctgtcttcacagctgttttcagcatatctgtaatcataaacgcagtataatcactcatggctgattttgattttggtgttaagtcaagcttcgtgccatcgttaaattcgatagattttacaaaatgcggttcattatacgttccgttatttccaaacgcgctgtatgcacctgccattgtcagaggagaaacaccatcgttcccaccgaaaccgccaatagaataggcctctgttacattatcttttgttaaaccaagcccgagtccatttgcaaagtctacagcagtatctttaccgactgcctggaatgcttttaaagcaggtatatttcttgattgggccagagcgtaacgcattgagataggccctagatatttgcggtcccaatcacgaatcggttttccgttagaatacgtataagctgagtcatcaatttgttcgtatgtggaccatttcttattttcaataactggtccgtagtccaaaatcggttttatggtcgaaccaggctgtgccttagtttgagtagcatagttaaagcctccgacaggctgattgcgtcccgcaccaatcgctcggacttctccgtttttggtatcgagaagcgtcacaccgccctgcatgccttcagtaaatccgacggtgtctccgtccattaattcatctagtttatcttgtgcttttgtatctaatgtcgtatagatctttaatccatcagcagatggatcgacatcagatttttcatcaatttctttcatgacttcttcaacaaacgcgctgtatttatttgaatttgttttttcatattccttctgtgacacaatgccttcgtctttcactgccacttttttcgctttgttatattgagaatcagaaataaatccttgctttttcatcagactgagtacaatgttccgtcgtttttccgctttatccgggtttttaacgggattgtacgctgtcgggctctgcggcattcctgccagtgtggcagcctgttcgacagtcaatttgcttaaatctgtaaccccgaaaaattcttccgccgcttttccgattccgtatgctctaggagaaaaataaatccggtttaaatacatttctaaaatttcatctttagagtaattgcgctccagctgaattgaaagccatacttcctggaccttccgtttcaacgtcttctgatgtgaaagaagggagtttttgacgacctgctgggtgatcgtacttccgccttcagccccgaagccgtctttaaagttggcaactaaagcaccgccgatacggacagggtcaatcccgtggtgctcataaaaacgggcgtcttctgtcgcgataaaggcttcttttacaacatcgggaatttcatctatcgagacgtaggtccgtttttcggcgccgacttcggcgatctcttttccatttttatcataaatcgttgatgaataaggcgtcttcaatttgctttcatcaagggacggcgcatctgaaaccataacggcaaatgtaacagcgccgccgactacgcctaaaacaaacagaatgagtaaagtgaaaagggtctttttaaacaatccgcccttttttcgtttcttgccttttttcggtgaagggctcgacttgctgttcgcttttcgtcgagcttcacggctgttaaattgatctgacataacatctcaacctttcgttaatcaacctttcgcaccagatgatggcgaaaaataaagctgttcaataatactaatataatcaattctgggtgcgtatccaagaaaaatcggataagctgtttcttccaactcatcttttcgaattgattttctgccgtttttttcttttctgtcccagaaataaaacagcttatcggcttccaaaaaatatacctggtcgaaagcggatataataacaaaacaaataccgtcttgagcctttacctgcttcatatgctcgatttgatggtcatgaaaattctgcagggggaaagaggtcttgtttttcgtttctttcgcctcaaaatcaatataccgccctttgtaaatcccattgtagtctgttgtcgatgattgtttaaagtaagcttctttaatcactgcggcacttctttttggataatggacatttacaatttgaacaggtgtcggctttttgtgtataacggcaatttggtttgtcagataatacttattcgtttcgtttaagtcatcttcgagggtcattccgcgattactgtaagacggggcccttttctgactgttttgggatgaaaccgaatgtttcggctgaaatgtttttccgttaggataccgaatcactttatcatcctccttattaaactaatcatgacggaagtgaatgaacgtgcaagaacaacagaccattagaaagcttctgagccggattgagcggcagacaaaaataaaaaacgcggataacatttcaagaacaaatgcttataaagcattttacgaccgtcacccggaaatcaaatggtcgcttttggcttctttcgtttctcgtaatgccggctggtcaatgactgacttaaaaggcagtctgtttcagcttggactccgtgagagacagcaagaatggttctttttagcctatgaaagagcgaactggcttattttttcggatgcctatccgcagcttctactataccactggtcaaaaagagttgggaaaccgctgtttcatctgctgcatgtgtttggcgtctcacaatttatgtcggaagaatggacccgtttttggcatgagcgaaatacggagcggctaatgtatgccctcattataaatgaacaaaacactatccaaacacctattatacaaaatccttcgtttaaaaagaatgtttttgacacgattcctttttatttaagtgattggttacattttaacaccgttatttttccttcctcaaatgggtttctttacggcatttcagtgaaacgcttttcaaaggcggaggaaaggataaggctgggaaagcagctgtctcaattgctgttcaagccagaattgttttcctctttttatcactttttgcacacagtgccgcacacaggttcccgttttgatatggaaaagatgatcgggattacaaaaagaacatctcctatgctaaggacatgctaccctgagttaatccactcattagacggaacgaaaacagattggtttcatggaaagataaagaaaacgttctttaggcgcgaggaattgccgaagcagattgaattgacagactggtatttacataaaaagcgccagcttcatgcgctttttgcggtggagcagtggctgaaaaaataaagaagcaaggaaattccttgcttcttacgtagaagggcggttcgggccgcctaattttttatctaaagaatcgattgcctttgattcagtctttttttgctggccggcttttttcggtcttgttttcatacggcacctcctcacaagtatcgtttgcattaacgaggaggatcatacaatttttgcgggtgtttttgtcgaaaacttcagcttttcgtggaatacctgtttgtttggcgatttgcttctagttttgtcatgaggaaggaaagagccttgagagcaaagaattttaaccgggagagacgaggaaagggaggtacacgaatgtccggttatgttagcaagacagatattctccgtatgctttctgatatagaagatgaattaacgcgagctgagcaaagcctgaatcattctgtaaatgcattagaggctgagatgcgggaaacggaaaacgatcgcctgagtgtgctggaagaagaaatcatagatcttcatatttgtataaatgagctgtatcaatcgcctgaacacaggtatgcgtttgagaaggtataccgcatcggctgaatttgcgagtgaaatttggtacgataggcattgaggtgaaagatattgctatcacaaactttgctggaaatgaccgagcaaatgattgaagttgctgaaaaaggcgctgatcggtatcaggaagggaaaaacagtaatcattcttatgatttttttgagacgataaagcctgcagttgaagagaatgatgaactggccgctcgctgggcagagggtgctcttgaattgataaaagtccgccggcctaaatatgtgcataaagagcaaattgagaccgtaaaggataatttcctggaattggtccttcaatcatatgttcatcatattcataaaaaacgattcaaggacatcactgagtcagtcctttatacattgcacgcagtaaaggatgaaattgcaagagaagacagccggtaaaaggctgtcttcttttcttttttatagggggccggacgttaattcatctcatatgccgggctttctgctccatttgcttcgagaaccttcatactgttacgaaactcagttatgctgagatgtccttgaatatagaggaacttggcaaagtccatcagtttattcatacagtctgtttcatatttcttcatttctgcaaaacgtttgcttaagtatgatacgttcattatggtgcatcccctctcatctgtattgaaaatatggtaccataatgattcgacttttttctgtttttaaaaaatttaaactttcgacacaatttgacaaatgctaatcatcacttgtgacacaaacaatagaagtcattcatacatatatagaagagaaatatgttgtgtttaggggggaatcgcaatgaacgggagctctcgaagctatcctcggcaaatgggctattattatcctcagcaaatgcaaggatattatcagcaggctgcacccggttatttagagcaacaactgcctcagcagcattatggacagcaggattattatcagccttatgctccgatccagcctatgcctatgcagccgcctgtattttctaacccttatcctatcccaaggcctaatcaacagcagccttcgcaatttcaaagcattatgtcgcagttcaaaaaagccaatgggcaatttgattttaataaaatgatggatacgacaggtcaagtaatgagtgcaatgaatcaggtcggatctttaataaagggatttaccagcttttttaaatgatagaagcatgaatgaatcgttcattcatgcttattttttggaaagaaaagtgtcattgtctgctcgttccaagacgtttccatatcttcttggcgaacttcataaggcagctgaaccgttcttgtcatgcttgtaaaggtagcctcattttggtgtttctgtttttcttggagtgttacatggagatacctcgatttaacttcaacgacgatctcgccatctcgaaacgtcgccggaatggtaatatcgatatacagcccagtatctctttctctgacatgtatggtcgtctgcacatcctttaaactcgagttgatcaggttctgaaatccgtttataaggttgccgaacgctgaggattgaaaaagagtgtcgattgcctccgttatgatttcttctttcttttgcagttcgttctttttgtcatcatagaattccaatttcgccaccgccttttttaaccagattatgcgtctatgccagatgttgttataaattgaagcaaaattgaaagtgtggttaaatagtggtgaatgaagggataacggttgaagtgaatgagaagggagaaaatacattgctgaaaaaattattcggaatgggcaaaactcaggaaaaggtgacagaagaggttatttattctccggcagacggtacagtaatggacctgtcagatgtgccggaccctgttttttcacagaaaatgatgggagaaggaatagcggtggaaccttctagcggtgaaatcgtttctcccgctgaaggtgaagtcattcagattttccacaccaaacacgccgttggcattcggactcgctcgggaattgagctgttaattcatgtcgggctggagacagtcaatatgaacggagaaggatttactgcccacattaaagaaggggataaagtgaaggtcggtgacccgctgattacatgtgatttggaattaataagagaaaaagcgagcagcacagtcatcccaatcgttataatgaatggtgaggctgtaggatcaattgtaccggcaggcgaaaaggctgctcgtaaaggcgaatcaaagctccttacaataaaagcgaaataagcagggcgtatgccttgctttttttattcaactgtataaaatttgcacctagccatgcaaacaaatattcggtaaactgtacttgacaaagaggtgtaaagaatgaaaaagaaatcactgactgaactcatttctgatttaaaaggaaatggtaacgttgtgaattggcatgaaattgagcctcgggaagcaaaaacaaggcctatgcccgaaagtatagacgagagaatcaaagcggccctttcgaaaaggggcattgatgaattatatactcaccaatattccgcttttcaatatgtgcaaaaaggagagagcatcgttaccgtaacgccaacagcatcaggaaaaacgttatgctacaacctcccagtcctgcagtccatcgcccaatatgaaacaaaccgggcgttatatttatttccgactaaagcgctggcacaagaccaaaagagcgagttaaatgaaattattgatgaaatgggcattgatattaaaagctttacatatgacggggatacgtctccggcaatcagacaaaaggtgagaaaagcaggtcatattgtcattacaaaccccgatatgctgcattctgccattctaccgcatcatacgaaatgggtcagtttgtttgaaaaccttaagtatatcgtcatcgatgagcttcatacgtatcgaggtgtgttcggcagccatgtagcaaatgtgatccggcggctaaagcggatctgccggttttatggaagtgatccggtttttatttgtacttccgcaacaattgccaacccaaaggaattgggagagcagctgacaggcaaaccgatgcggctggtcgatgacaacggcgcaccgagcggacgcaagcattttgtgttttacaatccgccaattgtgaacaaaccgctgaatattagaaggagcgcaaccgcagaagtgaatgaactggcgaaagagttccttaaaaacaaagtgcagaccattgtttttgccagaagcagagttcgggtggaaattattttaagccatattcaggagcttgtgaaaaaagagattggaacaaaatcaatcagaggctatcgggggggctatctgccgaaagagcgaagagaaatcgaaaaaggcctgagagaaggcgacattttaggagtggtcagtacgaatgccttagagcttggtgttgatatcggccagctgcaagtgtgtgtaatgacagggtatcccggaagtgttgcaagtgcttggcagcaggcgggacgagccggcagaagacacggtgaatctttgattatcatggtagccaattcaacaccgattgaccaatatattgtgcggcatcctgaatatttctttaatcgttcgccggaatctgcaagaatcaatccggagaatttaataattttagtagaccacttaaagtgtgcggcttatgagcttccttttagagctgatgaagaatttggagccatggaagtcagtgatattcttgagtatcttcaggaagaggctgttcttcaccgcaacggcgaacggtaccattgggcaagtgagtcgtttcctgcttcaaacatcagtttgcgttccgcctcccaggaaaatgtcgttatagttgatcagtcggatattgcaaatgtaaggattatcggtgaaatggaccgttttagtgcgatgacgcttttgcatgatgaagcaatttatttgcatgaaggcgttcagtatcaagttgagaagctcgattgggaccataaaaaggcgtatgtcagaaaagtcgatgtcgaatattatacggatgcaaacctggcagttcagctgaaggtattagaaatcgataaaacgaaagaaaaaagccgtacgtcattgcactacggagacgtcactgtcaatgccctgccgaccatttttaaaaaaataaaaatgaccacttttgaaaatattgggtctggacctattcatttgccggaagaagaactgcatacaagtgcagcttggctcgaaatcaaaacagcggatgaagacatcggggaaaagacactggaacagctgcttcttggcatctcgaatgtgctgcagcatattgtccctgtgtatatcatgtgtgatcgaaatgatgttcatgttgtttctcaaatcaaagcagcccataccggattgccaaccatatttttatatgatcattatccgggcggtatcggtttggcggaggaagtctttaaacgtttttcagacattaatgaagcggcgaaacaactgattacacattgtccttgtcatgacggctgtccgtcttgtataggtacggaaatagaagggataaaagcaaaggaaagaattttgcagctgttggatcaaatgtcgtaaggaggggggccggatatgtcattaaaagggaaactccagcggatgaaaaagcacatggtgctcgatgaaggagaacaaaaaatagaagcaggcaaacaagaaaaccactttgatgacatcccgtttttagaagagtgggaggcttttggcatgaagcctttcatcttcgaagatgaatactgccttatcagagaagtggaatatccgctttctcaccgccatgggttatacagcttttctgagcttgaggaagtgatcacactgtggaatcaaagcggtctgtcgcatacgttgtcagcaaaagggtataacaaaaacaacctctttttctttgatacagaaacaaccggtcttgggggtggagctgggaataccatttttttgcttgggcatgcgagagtatatgaagaccgagtgacagtcaaacagcatcttttgcccaaaccggggaacgaagtcgccttgtaccaaagctttttaagcgaggttgacattacatcacttgtgacctacaacggcaaagcctttgattggccgcaggtgaaaacaaggcacaccttgatccgtgacagacttccgaagcttccggagtttggccactttgatcttttgcatggagctagacgcctgtggaaacacaaaatggaccgcgtatctcttggcacggttgaaaaagaggagctcggcatccgcagactagaagacacaccgggctacttggctccaatgctttactttcattttatcaaggcgcaagagccggatcttttaaaaggtgtcctgcatcataatgaaatggatgtgttatcactcatttcattgtacatccatatgtctaaaaaaatcctttcagaatcacatgcgccaaaagaacacagtgaagcctatgctatggcgaaatggtttatggctcataaagaaacggaccaagcgatcaagcagttggaaaggcttatagaaaaatcgtttgaggacaaggacagtgcacggctggatttatcgctcctgtacaaaaaacaaaaccgcttggaagaagcagtgccgctttgggaaaagctgtcccgctcgcaaaaccagaagtgcagatacgctgctgtaatagagctcgcgaaatattttgagcataagaaaaaagaattcggaaaagcattgcaaatagcagagcaattgcttagcgaggcggcatgcttatcagagaaagaaactgaaaaactgcatgtgagaattgcccggctgaagaggaaatattcctcttaaatattccccgggaaagcgcaaaagacgacttgtttcgccatgaattttttttgctgaattcacattgattttgttgtagaatagcggcgaatcctgtaaaatgactttagttatttttaaagggagagttggtatgtataagggtgttttttacttgttctttgttgtggtatttttgattgcttttgtattttcaaactttaaagacagcttaattgcacacttttaaaataggtctttgcatcagaacatgtaccccttatttttcatagcttagtattgtaataaagtttatggaaaggggattttatcatgcatcactgcagaccgcatatgatggcgccaattgtccatcctactcattgctgtgaacatcatacgttttcgaagactatcgtgccgcacattcacccacagcatacaacaaacgtaaaccaccagcattttcagcacgttcactactttccacacactttctcaaatgttgacccggctacgcatcagcattttcaagcaggaaaaccttgctgcgactactagtatggaaaacgtgcagcttgatggtgtaaacaatgcagcacaacaaatggggcccacgggagccccattttttaaagcaggtgaaatgatgaaagtactggcaattacgggctataaaccgtttgaactcgggatatttaagcaggatgacaaggcgctgtattacataaaaaaagccattaagaaccggctgattgcttttttggatgaaggattagaatggattttaatttcgggccagcttggagcggagctgtggacggcagaagctgcatatgatttgcaggaggaataccctgacttaaaggtagctgtcatcacaccattttacgagcaggaaaagaactggaaagaaccgaataaggaacagtatgaagcagttctggctcaggcagactatgaagcaagcctgactcaccgtccttatgaaagcccgcttcaattcaaacaaaaaaatcagttcttcattgataagtccgacgggcttctacttttatatgacccggaaaaggaaggctcccctaagtatatgcttgggacagcggaaaaaaggcgcgaaaaggatggctatcccatctactttattacaatggatgacttgagagtgacagtagaggaagacagctactcatagcaataagagaaatttgacaaccgtacagatttctgaaaaaatatatgtgatgattcacgatacgaggtgaaaaagatgcttgctgataaagtaaagctttctgcgaaagaaattttggaaaaagaatttaaaacaggcgttagaggctacaagcaagaagacgttgacaaatttttagatatgattattaaggattatgaaaccttccatcaagaaattgaagaactgcagcaggaaaatctgcagctgaaaaaacagcttgaagaagcaagcaaaaaacagcctgtgcaatctaacacaacaaactttgatattttaaaacggctgtctaacttagaaaaacacgtttttggcagcaagctttatgattgatcacgcttgaaaaaaatggcgcttgtaaattgtaatcagttgttatataataattcatgttcttaacgttcgggtaatcgctgcagatcttgaatctgtagaggaaagtccatgctcgcacggtgctgagatgcccgtagtgttcgtgcctagcgaagtcataagctagggcagtctttagaggctgacggcaggaaaaaagcctacgtcttcggatatggctaagtatccttgaaagtgccacagtgacgaagtctcactagaaatggtgagagtggaacgcggtaaacccctcgagcgagaaacccaaattttggtaggggaaccttcttaacggaattcaacggagagaaggacagaatgctttctgtagatagatgattgccgcctgagtacgaggtgatgagccgtttgcagtacgacggaacaaaacatggcttacagaacgttagaccacttacatttaaaatgatgaaaacaagctctcccgtataaggagagcttttatcttgaaaagagaaaagttttaaaagacagggtgatacgatgaagaagtatacactaattgcaacggcgccgatgggcattgaagctgttgtcgcaaaggaagtacgagatttaggatacgaatgcaaggttgataacgggaaagttatttttgaaggtgatgcacttgccatctgccgtgcgaacctttggcttagaacagccgaccgcataaaggttcaggttgcttcttttaaagcgaaaacatttgatgaactgtttgaaaaaacgaaagcgattaactggcgctcatttatacctgaaaacgggaaattccctgtcatcggaaaatcggtaaaatcaacacttgcaagcgttcccgactgtcagcggatcgtcaaaaaagcaattgtcgaaaagctcaagctgcagtccggcaaagccaatgattggattgaagaaacaggtgccgagtataaagtcgaaatttctttattgaaagatcaggctttgattacactggactcatcagggacaggccttcacaaacgaggataccgtgtcgatcagggcggtgcgccgattaaagaaacacttgctgccgctttggtgcaattaaccaattggacgccggaccgcccatttgttgatcctttctgtggctccggaacaatcgcgatagaagcggcgctaatcggccagaacatcgccccgggattcaatcgcgattttgtttcagaggattgggaatggatcggtaaagatctgtggaacaaagcgcggcttgaagtcgaagaaaaggcaaattatgatcagccgcttacaattttcgctagcgacatagaccaccgcatggttcaaatcgcaaaagaaaatgctgaggaagcaggattgggagatctaatccagttcaaacagatgcaggtcaaagactttaccacaaatctggagtttggcgtaattgtcggcaacccgccatatggagagcgtctcggcgagaaaaaagccgttgagcagatgtacaaagaaatggggaaggcgttcgagccgcttgatacttggtctgtgtatatgctgacatcaaatgaaaactttgaggaagcatatggcagaaaagcaacgaagaaacgaaagctctttaacgggtttattaaaacagattattatcaatattggtcaaaagtaaggccgcagcgaaagaaaacagaaaacgcataaaaagaagacgctctgcatgcgtcttctttcatctttcagccctattctatcgttaccaacggtgagctttcgcgttgcttctcaatataatgttggtttgggacatttcagtgtgaccgtttacttgagacttagaacgtttaggccgcgtccaattgtgatgaaacagttcagaatgctgatctaatcggtttctataactcatctcaacatcactccctgatagaatattgttgataagacggataatccggagacggaatatcaagtgtagtttgtgcatgtttcggtgataacatgcggtaaagcatgtatataaaatgaaaagttcgcatacaatgatgattatttccatcagaggtgatctcatgctgaacagcgaacattttaatcttattcaaagggcgcttgacgcaacagcaaacgagctgaaggagctcgggactgattcgtctccgtctgtgatttcgcatgcgcaaactgatttagaaaaagcggtagaacatatttattcaacagaccatccttttttatcgtcgcatgtgatcaatcgtaagtaaactgcaaaaaacttggcattgccaagtttttttattgtattcatcagcggaaaatgatattattggtggtctgaatgtcgaatagttgggggttggaactaggtgacaacatcacgtttgcctttttctttaacgaaaacaaagaatttttatgaagaattgaacaattggattggtgacgtgttttacgatatccttcccgaaaaagggtttgatcttcgggacgagcaagtatttatggcttttcagctggagcgggcgtttaaagagaaaaaagtcatgttcgccgaagctggagtgggaacggggaaaacgctggtttatcttctttttgcaatcagctatgcaaggtatgtcggcaaacccgccatcatcgcttgtgcagatgaaacattaattgaacagctggtgaaaaaagagggcgatatttctaagctggctgagcatcttgatctgaaaattgatacaaggctgtcaaaatcacatgagcaatatttatgcttgaagaagcttgaaaaaacaatgcagcgttctgatgatgataaatggctggatctttatgagtcgttaccgtcatttgtccacgagtcacaggcgatgcagcgcttttatccgtatggcgaccgtaagcagtacgcaaatctatcgaatgaagagtggtctgacgtaagctacgactcgtttcaggactgtctgacttgtgatatgagacacagatgcggtctgacactttccagagattactaccgcaagtcaacggacttaatcatttgttcccatgatttttatatggagcatgtgtggacggaagaatcacgcaaacgagagggccagctgccgctcttgcctgatcatagtgcagttgtatttgatgaggggcatttgttagagtttgctgcgcaaaaagcgctaacctatagagtgaagcagtctactcttgaattgtttttagaacgattgctgcaaaatgacatcagagaagagtttgcagaattgattgaagatgcgcttgctgcaaacgacgaatttttctatgttctttctgaagaatcaaaggaagtagccggttcacaccgtttagaaataaaaaatgaccagcgtgtcaaaaaggcggcggacgagctttgccgtttacttgataaaatcggtgaggcacttgtatttgagtcagaaatgtatacgattgatcaatacgagttgtcagtagtggaagaatacgttgaacaaatggcgtattcattatctctatatcaaaaggatgcaatcagctggctggagaaaaaggaagcagaatcaacttttgtcgtgatgccgagaacggtagcagaagtacttggcgaaaaagtgttttctaagaaaattccttatatcttctcttctgctacgctgtcagaaggcggttcgtttgattatattgccgacagtcttgggattcatgattatttgtcattaactgttgattccccttatgattatgacgagcaaatgagtattaatttatacgcaaaaacagatatggccgctgaacaaaaaacggctgaaacgattgaaacaatcaaacgatacaaaggaagaacgctggtgcttttcccttcttttgaagaattaaacgagtttaaagagctgtcggcggcatgggagctgccgtatccaattttcttcgaaggtgatgaggaaatcagcagcttagtagagaaattccaagaggaagaagaaacagtactttgttcagttcacttatgggaaggactcgacattcccggtgacgcattgaagaatgttaccatttggtcattgccgttcccgccacacgatcctgtatttacagcgaagcgcaacggagcgaaaaaagatccgttcgaagaagttgatctgccatatatgttgttacgtgtacggcagggcatcgggcgcctgattcgctcgaatcaagacagcggctcgattcacatttacgctggcggagaaaatgaacgcatcattgatgaggtcaaaaaggtcttgcctgttgaaccgcacatgatgtaatggaaaaaagctgacgatcgttcgtcagctttttttatttgtcagcgggatagccagccgccatcaactgctaaaatatgtccatttacataatctgaagcacgtgatgccaaaaagactgcagtccccccgatatcatccgcttggccccagcggccggcaggaattctctttaaaatgtcctcatttcgcttttcgtcatcccgaataggctttgtattcgcagtagaaatatagcctggggcgattgcgttgacctgaatacctgacgctgcccactcatttgcaaatgattttgtcaaaccggcaacagcgtgtttgctcgcggtgtaagccggaacaaggatgccgccttgaaaagacaggagagaggcaatattaataatctttccatgacctcttttcagcatgtgcctgccagcaagctgtgtcagaataaacaggctgtgtagattgacattcagtacgtgctgccagttctcttctgaaaaatcttccgctttttcccgatgaataatgccggcattattgacaaggatgtcgatctgcctgttttcaaacaggtcagctgcagaatcctttatcgcttccggcttgctcatgtccaatgtaaaagatgtaaatatccggccttcctgttccacaagctgctgtgtttcagacagactgcttgtatgtgatgtaccgataatatcagcgccagccccggctagggctttggcaataccttgaccgatccctgttcccgggcctgtaaccagcgctgtttttccttctaatgaaaaggcgtcatgtagataacccatcttatttcagcccatccatcggaacgagatccatgtccgtaaatgtgtaattttctccagccatcgcccacacaaagctatagtttgatgttcctgcgccagaatgaatagaccaggcgggagaaaggacagcctgttcatttccaacaacaagatggcgtgtttcgtccggctggcccatgaaatgaaatacctttgagtccttttcaagatccagataaagataagcctccatccgacggtcatgaacgtgtgctggcatggtattccagttgttgttttgatctaacatcgttattcccatcatcagctgacagcttttaatgccatcctgatgaatgactttgtacagacttctgacattagatgctgcatcatcaccaagacggtccggtgtcagttcagctagggcggctttttgtgtcggatagcttttgtgggcgcaagcggagacgaagtaaaacttcgctttttcaccgttcaggcttgaaaatgatacatcctgattacccattccgatatagagaaaatcctttgtttgaagcacatattcatcatcgccgactctaacggcaccaggctcgccgacattaataatcccgatttcacgccgttccaaaaagaagtctgtttttagaaaatcacctgcatcaagcttcagttcactttgccctggagccgctccgccgatgacaacccggtcttcatgtgagtaatacatcgtaagtttgttttctgtaaataaaggatccattaagaaatgactgcgaagctcctctgttgtaaagcgttttacttgttcaggatgtacagaataacgattttccattatatttcccccttggttaggatttcagcatcacttgaatgaaaatattttggtaacggtttcaaagaagattttaggataaatagtgaaaagagtcaacgaaaaaataatgaattgacacattattaaaaaaactctttccaaattttaaaattatggtatccttttgttgtaacggttttgaaatcggtttcaaatatatgagatacaggagcacttgaatgaaaaagaaaacaacaggccatacaaccatcaaagatgtagctgaatgtgcaggagtttcgaaatcgacagtttcccgctatattaacggaaaaattgacgcgatttctcctgaaaaagtgaaaaacattaaaaaggcaatcgcagaattgaattatcggccgagtaaaatggcacaaggtttgaaaataaaaaaaagcaagttaatcggatttgttgtggctgacattacaaatcctttttcagtcgctgctttcaggggagtcgaagaggtttgtgatcaatatggatacagcattatggtgtgcaacacagataacagtcctgaaaaagagcgggaaatgctcttaaagctagaagcccattcggttgagggcttgattttaaacgcaacaggggaaaacaaggatgtactccgcgcttttgctgaacagcaaattccaacaatcttaattgaccggaaactgccggatctgaaactggataccgtaacgactgacaacagatggatcacaaaagagattcttcagaaggtctacagcaaagggtatactgatgtcgcgctgtttaccgaaccgatttcctctatcagccctcgtgcagaaagagcagctgtgtatcaggaaatggcttcggttcaaaatgtgaacgggcttgtcagattgcatgaaattgacgtaaaggacaaggagcagcttaaggcggcgcttcgttcttttcacaaggaaatgccggagcaaaaaaaagcgattctggctttgaatggcttgattatgctgaaaatcatcagctgtatggaagagcttggcctgcgcatccctcaagatatagggattgcaggattcgatgatacggaatggtataaactgatcggtccaggtattacaacgatcgcccagccgtcacatgatatgggcaggacggcgatggaacgtgtattaaaaaggattgaaggtgacaaaggagcgcctcaaaccattgaattagaggcaaaagtcatcatgagaaagtcactttaatcctaggtgccctcaactaagaggaggttgggaagagatgaagcttgatgcggtgacattcggggaatcaatggccatgttttatgcaaatgagtatggaggccttcatgaagtatccactttttctaaagggcttgccggagcagaaagcaatgtcgcctgcggccttgccagactcggattccgaatgggatggatgagcaaggtcggcaatgatcagctcggaacgtttattttacaagagcttaaaaaagagggagtggatgtgtcccgtgtgatccgctcgcaggacgaaaatcccaccgggctgctgctgaagtcaaaagtgaaagaaggcgacccgcaagttacctactataggaaaaactcagctgcaagcacattaacttcagctgaatatccgagagattattttcaatgcgcaggccatttgcatgtgacaggcattccgcctgctttatcagccgagatgaaagacttcacgtatcatgtcatgaacgacatgagaaacgcagggaagaccatttcattcgaccctaatgtaagaccttcgctttggcctgatcaagcaacaatggtacacacaatcaatgatctggctgggcttgcagactggtttttcccgggtatcgcagagggagagctattgaccggagaaaaaacacctgaaggcattgccgactattatttgaaaaaaggtgccagctttgttgctattaaacttggaaaagaaggcgcttactttaaaacggggacaagtgaaggatttctagaaggctgccgggtcgaccgggtggttgatacggtcggcgccggagacggatttgcagtcggtgtaatcagcggtatcctagacggtttgtcgtacaaggatgcggtgcaaaggggaaatgcgattggcgctttgcaagtgcaggcaccgggggatatggacggtttgccgaccagggagaaattagcttcttttttatctgctcaaagaacggttcaccaaaagaaaggggattattaatatggagtccaaagtcgttgaaaaccgtctgaaagaagcaaagctgattgcagtcattcgttcaaaggataagcaggaggcctgtcagcagattgagagtttattagataaagggattcgtgcagttgaagtgacgtatacgacccccgaggcatcagatattatcgaatccttccgtaatagggaagatattttaattggcgcgggcacggtcatcaccgcgcagcaagctggggaagctgctgaggctggcgcgcagtttattgtcagtccgggtttttcagctgatcttgctgaacatctatcttttgtaaagacacattatatccccggcgtcttgactccgagcgaaattatggaagcgttgacattcgggttcacgacattaaagctgttcccaagcggtgtgtttggcattccgtttatgaaaaatttagcgggtcctttcccgcaggtgacctttattccgacaggcgggatacatccgtctgaagtgcctgattggcttagagccggagctggcgccgtcggagtcggcagccagttgggcagctgttcaaaagaggatttgcaggctgttttccaagtgtaagtggaattgttttttcataaccggaggatgggagaatccacaatatgaaaatcaaggcgacaattgaacgggtacctggcggaatgatgattattccgctatttcttggagcggcgctcaacacgtttgcgcctggaacagcggagttctttggagggtttacgggtgctttgattaccggaacgctgccgatactgggtgtttttatcttttgcgtaggagcaacgattgattttcgttcttcaggctatatcgcaagaaaaggaatcacgttattattggggaagatcggatttgcggcgctgctcggcgtgatcgcagcgcaatttatacctgacgaaggcatacaatccggcttttttgcaggcctttctgttttagcaattgtcgcggtaatgaatgaaacgaacggcggactgtatttagcgctcatgaaccatatgggaagaaaagaggatgcgggcgctttcgcctttatcagtacagaatctggtccttttatgaccatggtgacgtttggtgtgacgggacttgccgcattcccatgggaaacgctggcagcgacagtcatcccgtttttacttggatgtatacttggaaatctggatcatgatctcagagacttattcagcaaggttgtgccggcgatcattccatttttcgccttttcgctcggcaataccttgaattttggaatgctgatccaatcagggctgctcggcatttttatcggagtttctgtcgtcattttatcgggcagttctttgtttttgcttgatcgttttattgcgcggggagatggtgtcgcgggagtggccgcttcttctacggcgggggcggctgtagccgtgccatatgcattagcggaagcgaatgcctcatttgcgccagttgctgagtcggcaactgcaattatcgcgacaagcgttattgtcacctcgctcttaaccccgctggcaacagtgtgggtagataaaaaaatcaagcagaaaaagcggagaacacctccgccaaaaaatcaaatgacgatcaactgaataaaaaggctgccataaaaacataccggcagccttttatacaaacaatttgactttcatacccccttccattagcctgtaatggaacggctagaatagggagggaatggatatggagatacatacatatgaaaaagaattttttgatcttttaaaaagaatctcacattacagcgaagcagttgcgttaatgcactgggactccagaacaggcgcgccgaaaaacggctcagaggatcgtgccgaaagtatcggccagctttcaacagatatattcaatatccaaacatcagatcgaatgaaggagcttatcgatgtcctgtatgaacgattagatgacttgtcggaagatacgaaaaaagcagtggaactggcgaaaaaagagtatgaagagaataagaaaatccctgaggctgaatacaaagaatacgtgattctgtgttcaaaggcagaaacagcgtgggaggaagcgaaaggaaaatctgatttcagcttgttttctccttatttagaacagctgattgaattcaataaacgttttattacgtattggggatatcaagagcatccttatgatgcattgcttgatttgtttgagcccggcgtcacggtaaaggtgcttgatcagctgtttgctgagctgaaggaagcgattatccctcttgttaaacaggtgacagcttccggaaataaaccagatacaagctttcttacaaaagcgttcccgaaagaaaagcaaaaagagctcagtctgtattttttacaggagcttggctacgattttgatggcggaagacttgatgaaaccgttcatccgtttgcaactacgctgaatcggggagacgttcgggtcacgacgagatatgatgaaaaagatttccggacggcgatctttggtaccattcatgagtgcgggcacgcgatttacgagcaaaatattgatgaagcactcagtggcacgaacttgtcagacggcgcatcaatgggaattcatgaatcgcaatcattattttacgagaattttatcggccgcaacaagcatttttggactccgtactatcagaagattcaagaagcatcacctgaacagttcaaggacatctccctggatgattttgtccgggcaatcaatgaatcaaaaccttcatttatcagggtcgaagcggatgaattgacgtatcctcttcatatcatcatccgttatgaaattgaaaaagcgattttcagcaatgaagtgtctgtggaagatctgccgtcgctttggaatcaaaaataccaggattatttagggattacaccgcagaccgacgcagaggggattttacaggacgtccattgggcaggtggagatttcggctacttcccatcctatgcgctcggctacatgtatgcggctcagctgaaacaaaaaatgcttgaggatctccctgaatttgacgctctcttggaaagaggagagttccatccgataaagcaatggctgacggaaaaggtgcacattcacggaaaacggaaaaagccgttagacattattaaagatgcaacaggagaagagctgaatgttcgctatttaattgattatttatcaaacaaatattcaaatctctatctgtcataatcaaaagcctggcggcgcggtcgtcaggctcttttatatcgtatacccttgaaatacgaatgatatctaaaaaaacaaaaataaagttcgggaatttttattttcagcctatgcaagagattagaatcttgatataatttattacaatataataggaacactcatataatcgcgtggatatggcacgcaagtttctaccgggcaccgtaaatgtccgactatgggtgagcaatggaaccgcacgtgtacggttttttgtgatatcagcattgcttgctctttatttgagcgggcaatgctttttttattctcataacggaggtaagacaggatggaagcactgaaacggaaaatagaggaagaaggcgtcgtattatctgatcaggtattgaaagtggattcttttttgaatcaccaaattgatccgctgcttatgcagagagttggtgacgaatttgcgtccaggtttgcaaaagacggtattaccaaaattgtgacaatcgaatcatcaggtatcgcccccgctgtaatgacgggcttgaagctgggtgtgccagttgtcttcgcgagaaagcataaatcgttaacactcaccgacaacttgctgatagcgtctgtttattcctttacgaagcaaacagaaagccaaatcgcagtgtctgggacccacctgtcggaacaggatcatgtgctgattatcgatgattttttggcaaatggacaggcagcgcacgggcttgtgtcgattgtgaagcaagcgggagcttctatcgcgggaattggcattgttattgaaaagtcatttcagccgggaagagaagaacttgtaaaactgggctaccgagtggaatctttggcaagaattcagtctttagaagaaggaaaagtgtccttcgtacaggaggttcattcatgagaaatggattcggcaaaacgctgtctttagggattcagcatgttctcgccatgtatgccggcgccattgtcgttcctctgattgtcggaaaagcaatgggactgaccgtcgagcagctgacttacttagtatcaattgatatttttatgtgcggtgtggctacacttctgcaagtgtggagcaaccgattttttgggatcgggcttccggtagtgcttggatgtacctttacagctgtatcgccaatgattgcgattggatctgaatatggggtttcaacagtttacggcagcattatcgcttcaggcattcttgtcattcttatttcatttttctttggaaagctcgtatcgttttttccgccggtcgtgacaggctctgttgttacgattatcggtattacactgatgccggttgccatgaataacatggccggcggagaaggaagtgcagatttcggagatctctccaaccttgctcttgcttttaccgtgttgagtatcattgtgcttctgtaccgttttacaaaaggctttatcaagtccgtctcgattttgatcggtattttgattggcaccttcatcgcttattttatggggaaagttcaatttgataatgtttcggacgcggcagttgttcaaatgattcagccattttacttcggcgcgccgtcttttcatgcagcgcctatcattacgatgtccatcgttgcaattgtcagccttgtggagtcaactggtgtttactttgctttaggtgacctgacaaaccgccgtttgacagagaaagatttgtctaaaggctatcgagctgaaggactggctgtgcttctgggaggtatttttaacgcttttccttacacggcattctctcaaaacgtcgggcttgttcagctcacagggatcaaaaaaaatgccgtcattgtggtcacaggtgtgatcctaatggcatttgggctgtttccaaagatcgctgctttcacgaccattattccatccgctgttttgggcggtgcaatggtggcgatgtttggaatggtgattgcttacggaattaaaatgctcagccgcattgattttgcgaaacaggaaaatctgctgattgttgcttgctcagtgggattggggctcggcgtgaccgttgtgccggatattttcaaacagcttccgagtgccttaacgctgcttacaacgaatggcattgtgacgggcagctttactgcagtcgtcttaaatattgtatataacgttttttctaaagctaaaaaaacagaacaagaagctgacctcgctgaacaaaaaacagcagtctaactccgccgcggcggagtttttttgcatataaaaaagattgttgcggcacaatgtatgcaaagaggtgatcgcatggcgtttattttatccattggaacaagtcttcctgcgtataatgtaaaccaagagaaagcggccgagttcgcccgctatatgtttcagcattcttttaaggatattgaccggctgttatcctcctttaaaaacgggcaaatccattcgagacagtttgttaagccgattgaatggtataaagaggggcacagctttgaagaaaaaaatcaaatatacatagaagaaacacttaaacacagcagagcggctgttcgtgagtgcctctctcatccggaattttttcaagaagccattccttatgagaaagtggaagctgtttttttcgtctccagtacaggtctttccacaccgagtatcgaggcgcggcttatgaatgaacttccgttttctccatatacgaagcggatcccgatttgggggcttggctgtgcaggaggagccagcggacttgcgcgtgcagccgaatactgcaaagcgtatcctgaggcttttgtgcttgtcattgctgccgagctgtgcagcctgacattccagccggaagataaaacgaaaagcaatctgatcggcacctcgctttttggtgacggcattgccgcagctttattatgcggagagaaggcggaccgcaggatgtcaaagctgaagcttgcgccgaagataatggacgcccaatctgttttgatgaaacaatcagaagatgtcatgggctgggactttaccgatcaaggattcaaagtcattttctcacgagacattccaaccttggtggaaaaatggctcaaaacaaatgtacagatttttttggacaaacataagctgtcattccatgatatcagtgtttttttggcgcatccaggcggaaaaaaagtgatcgatgcatacatcaaaagtctcgggctgtcgtcagaaaagctttcatctgcgcaaagcattttgcaaaagcacggaaatatgtcttcagccacaatcttgtatgtgatcaaagaccatctgcagaacggacataaaaaggaagctgaacgaggactgattggcgcattagggccgggtttctcatcagaattgctgttattcagctgggaaaagggggcctgactcatgttttggttgttgatcgccattctcattgttcaaagagcagcagaaatggcagtggccaggcaaaacgaacaaaaggtaaagaagcaaggagcaattgaatttggcgagagccactatccgtatatcattacgatgcatatcctttttttcctgtccttaattgccgaggtgctgctgatgaataaacagccgtccagctggtggctcggtatcgctgcagttattttaagcgtacagatcgtacggtattgggcgctttgttccttaggggcatattggaatacgaaaatccttgttgttccaggtgtagagcttgtaaaaaaaggtccatataaatggatgaaacatccaaactatgccgttgttatactcgaaattttgctgattccgctgctttatcaagcatacgtcaccatgtgtctgttttccattttcaatgccgtgttgttaagcgtcagaattcgcgcagaagacaaagcattacaggaatacagcgtaaaatagcgattgaaaatcattctcaaccatgttaaaatggatttgaaaaagattctcaatcaggatggtgaagcaaatgacaatgctgtttttgcttggagcggtttgtacatatagtgtattaattggttttgtattaaaaggaatctctaataaatctgtttgatgaatctggaacttgtaaaagttgcagattttcttttatagaagctgccgtaatggcggcttttttctattctcctaaagaaatttggtttattcttgtgtaaaatgaaaagggaatgaattcagatctttcgaaaaaggttcacaattgaaacggcacaaaggggttcagacttatgacagatcaaaacagaaaagagcttttgcataaaaccggggaactttataagcaatttattgagaatcaagatgaacaaagggctgctaaactggctgcggtcatgaaaaaagcggctgatgaagaggtttatatcgcgtttaccgggcattattcagcggggaaatcgtcactgctgaactgcctgttaatggagaatattttgccgacaagcccgattccgacaagcgctaaccttgttgtgatcagaaacggggaaaagcgagttcggcttcatacaacagacggagcgtgtgctgagctggaaggggcttaccagaaagacaaggtgcagcaatattgtaaagacggggaacagattgaaagcgtcgaaatttttgacagatatactgagatcgattccggggttgcgtatattgatactccagggatagattcaacagatgatgcgcattttctatcggctgcttctattcttcaccaagcggatgcgctgttttacgtcgttcactataatcacgtgcactctgaggaaaatgtaaagtttctcagatcaataaaagaaagcattccgaatgtgtattttatcgtcaatcaaattgaccgccatgatgagacggagacgaaatttggagactatcaagcgcaggtagaggagatgctttgcaatgaagggatttcaaaggaagcgctctattttacgtcagtaacagaaccggaccacccgttcaatcagatgggggccttgagagaagagttaagaagaatagaacagcaatcaaaaagcaatatgcaggctttaaccgaacaaaaagtccgtaatctgctaaaggaacatacggaaatgctgaagaaagacgaaacaggcgctccgagtttcgctgaacagcttaatatccaaactggactggtccaatcgctgcgtgatcaattggatgaggccgaaaaacaaacgactgaggcagagaagaggatgcaggaagaaatcaatcgtattttaaaaaacgccaacctgacgccttttgaaatgcgtgaattggcggctgcatttttagaatcacaagagccttcctttaaaaccggctttttcttttctaaagcgaaaactgtaaaggaaagagataaaaggcggaatgcttttttctctgatgtggctaaacgaacagaggccgaagcggattggcatatgatagacacgcttcataaactcgccaaggcatttgatgtctataccgctgaaagtgaaaagctgattcaggcctatcgcacaccgcttgatataagcatcattgaacgcgcggtcaagcatggtgcagccttttcttctgaatatgtattgcaatatacaaaagatttggcagagctcatccggaaagaggcgaaaagagaagccgcagacatcataaaggtgctctccgctatggtgaaagagcgtgtttccaaagacgtgcaaacgattaacgaccggctcgtccaagaatcagaaaaacttgtctttcttcaagaacaggcgcgtttagagaataatgcccgagagaaaaccgatcgcctgtgggccatttgggaagaagagtccgcatgcccaatgcatatagacacagaatggtttaaatcgaagaaaacaagagtggcggctccagagcagaaacaaggccgaagccagctgacggcgcagccgatgccgaaatcagaaatcaaaatggaacaagaaatgccgcttcaagaccaaatcaaacgcttttacactttgtctgaccttttaggcgaatgcagcatgttgttaaagcaaacttcagcgtttcgtgaaagggtgaaaaggcttgaggaacggaaatttacactcgctctttttggaggcttcagctcggggaagtcatcatttgccaatgcgcttgtcggcgaaagagtgctgccatcctcgccaacgccaaccacagcgacaattaacaagatcacaatgccaatcaatggcaacttaaacaaaacagcggatgtagtgtttaagacagaggatgacataacggctgaaattttgcagctcaccggaataccaaaggaaccggcaggccgttccttcacagagaagtgggaaaaggcagtcaaaaaaaacaggctgcaggaagaacacgtgaaattgatcagcaatttcctgcttgcatatgagaagtatcagcagtatatacaggaacagaagaaattaacgattccgctatctgaattaaagccgtatgtagcagaggaaacaacggcctgtgctgtgaaagaggtaacggtctactatacatgcccgctcactgaaaaagggattacgatcgttgatacacccggcgcgagcagcatgaataaacggcatacagaactggcattccaatatatcaaagatgctgatgcatttttttatatgacttattatcagcactctttttcaaaaggagaccgttcatttttgcgaaagcttggacttgtgaaagaatcgctcagcatggataaaatgttttttattattaatgctgcagaccttgcaaaagataaaacagaactcgaaacagtgaccgattatgtcagcgcagagcttgtaaaagaaggggtttatgaaccgcagctctttactgtatcaagtaaggaggaactggtgggaaaaccggagtcattttacaatcagttctcaaaagtaagaaaacacttagaccggtttatcgaagtggatgtaaaaaaagcgtcagcagcgcagctcagttcggaggcagacaaactatgcgaaaccgtttttcagcttcaccaatcccggcatcagtcccgagaagagaaggaagcgcagaaacagcgccttatgctgtcatttgagcggacagcggccgatatcgagaaacggcggaactcagaaaccatcattgaaaaagtaaaaaaagatacaagagagcagctatatcacattacacagcgattatcatattttgcaaatgatttattaaaatcggcatttcatcccgggctgcaaaacggggattggaaaaagaacgtcagtaaggcgatgacaacagccttacatgaatatcaatttgaatatattcaggaaatcaaaacgcttgatgttcgtatgagcggtttcatcgaacggcatatcaatgaagaatggctggatcaatttcaaaaaacattaaatgaggacggctatttttccgtttatgcgggtgatcagcattcaaacggcatacagttgaaggaagttgaaccagaaatagaagaacgtgctttcgagcaggaactaaaagaggtcaaatcaccgaagcagttttttgagcagaaaggaaaatcggcctttatcgaagctgtacggatgaaacttacgaaaatcacagaggcatggataaaaaatgaagaagaaagcctgatttctcattacacagctcacctcagacgcttacaggaagatatgggcgaaaaagcaatcgcgcaaataacggatcaaaaagagacatatttaagaggatatgcggaaggggaacatgcgaaagagattgaaatagcgtaccaggcgtgcatctcctggaaaaattcagacaatacaataaaaatgtaaaattcagttggcttgtatttcaagtcatgatagactaaatagaaaaaagcgagatgaacgattaatgtcagaggtacataaagcaatttcagcacattcatcaaaacagcacgagcatatcaaagcatttatgcgtcttgaaaatatgcgtgaattggcgattgaagaagctgttgcgaaatgcagaaacgatgaaccttatactacagatgcaattaatgaaattaccgagcaaatgaatcagctcgctaaaaaaggcatcgtcccgacaagacggcttgtatcaaaagaaatggtcagagaatacgtaagccgcatgtaagctggatgatcctgtcgcgagtgaacctcctgtaggaagcatatactatatgcatccgacgtaaggggggattcatgttgggcagaacaaagctcggaaacagaaatgcacaggcgaataacaatgccaaaaagaaaaacggatttcaaacccattttgactcttacgcaggacgcgaagctgaaaaactgatcgccagcaacaaaagacacaacgattgataaatatccaaacagtatctctaattaaagagatactgttttttatttttgggctgctttatgataaaatagaaggaatgaaagaaaagggagttatttgatgaataataataaactattgctggttgacggcatggctcttttattccgggctttttttgccacggccgtacatcgcaactttatgataaatgacagcggggtgccgacgaacggcgtcaacggctttttaaagcatttgattacggctgtggaaacattccagccgacacacgtcgtctgctgctgggacatggggagcaaaacgtaccgaaatgacttgttccaagattataaggccaaccgcagcgcgccgcctgtggagctgattccgcagtttgatttggcaaaggaagcagccgcagagcttggaatcatgaatattggctttgccggctatgaagcggatgactgtatcggtactcttgccgatttatttgcgaatgaagcggacattacggtcgtaacaggggacagagatttacttcagctgttaacggataaagtaagcgttgctttgcttcaaaaaggaatcggaaattataaagtctatacaaaagagactttttatgaagaaacaggcgtaatgccgaaggctttgattgatattaaagcgcttatgggagattccagtgataactatcccggagtcaaagggattggagaaaaaacagcctacaaactgattcgtgaatacgaaacgattgaccgtttattggaaaatctttctcttcttccaaaaggacagcagggaaaaattcagcaaggtttaagcgatttggagatgtcgaggaagcttgcggaaatccattgctcagtgccgctggcctgcacactgaaagacgctttatttactttgcaaatggagcaggcggctgacatgcttcgccgccaccaaattaaaggaattgagcgtatgcttgaaaagctgaacgctagagagatcgtttagatcctctctagcgttttgtattgcttttttttgctctctcctcaagctctgttttagggtcattatgtgtattgccttccaggtcgccttgcggagtaacaccgccggtcagccggcctttatctttctttttcatgttagttcacctcgccattaggatgaaccaatgatcaagatttaattcttttcattcagccgaatcgcttcttttgccagaagatcggctttttggttttgcttgcccggtatccatttgatgaaaaaaagagggaatgccgcttttaatcggatgatctcttctacaaacggttgaaacgttatatttttaaccatttcaagctcagtggcgcgttccacaatatctgaatcggttcgaaaggaaactgattgatacccgcgcgttgcacatagcttcatcccttcaattaatgcaagaaattccgcttcctggtttgtatgcactccgattggaatagagaaagattctgcttttccctcatgtttgataaaaatgccgataccggaaggccctggattaccggcgcttgcgccgtctacatatatttctgtaggcattatgaactcctttcatcattaggtatcatttttttggctgcataggcataaggcaatgaaattaaagataccgcaaacttaatcaaatatgtagaaataaaaatatgaagccacacgcctgccggataaatgccgagaaaggcgactgaagtgaatatgaatgtatcaaacagctggctgactgctgtactgccgccgtttctgagccataaaagccgatcagaaggaaatatccttctaattgccgaatatacataaacatccagcgtttggctgaagataaaggcaagcagacttcctaacgcaactcggggaaggaatccgaagatcgtttccagcgctgtttgtgatatgtcgctggaagccggttcgaaaagcagcacgccctgcatgacaaatgtcagcgtcaggagcgttgagaatccgagccataccgcttttctggcttcagctggtccgtatttttcattcagcacatctgtcgcaaaaaagattgtgccatacatcacattcccgagtgtcgctgttaagccaaacagttcgactgttttgacgacttggaggttggcgcagactgtcgcaaaaccgatccaaacaaacagtcccattttgccaaatcctttataaaataaaagaacaatgataaaatgaatgatcgcaaaaaagatccaaaacgaattattaaacaagatgaaaaagcttcctttccggggtaagattggtttgattatagcataagcccggcaactaatgaatggtaaggtgattgtaatgaagctcagaccgcatttgaaaatagaagcaaaaggaacgggatccgtctcattttttagcgaagactggctgacagcacagcaggcacgtatgttcgccagagaacttggccgttttccatacatgaaggagctagagttcgaagacgagaaaggcggcagctggacgctgaaggaattggaaaagctgacagaggagcttgctcaagagcctgatgacattactgtttattttgacggcagtttcgataaagagagcgaactggccggtctcgggatcgtcatctattattcattgggaggaacccggcatcgcttgagaaaaaataaaagcttccggctgaaaaccaataatgaagctgaatacgcagcgctttatgaagcaataagagaagtaagagagcttggggcaagcagaaattcaattacaatcaaaggggactcgcttgttgtgctgaatcagcttgacggcagctggccttgttatgatccatctcataatgaatggcttgacaaaatagaagcactccttgaatcgctgaagcttactccaacctacgaaacaatacaacgaaaagacaatcaggaagctgacggcctcgctaaaaaaattctatcccatcaattcgtagaaagccacacgaaattagaccgtaacggagatgacgatattggataagaaaatgatctttaaagaactgacagaactgcacgatgaatattgcaaggactgttttattaagaagcagtttcgcaaagaatttggcaaaacttatgcgcattcattttgtatcaataaatgtacggttggtgaaaagctgaaacaatacggagatgtcttaaccaatcactaaaaataaaaaccgcagaagctgcggtttttattctttgaattcatccagctgatgctcgctgtcatctagcagctgctgttgctgctttacaaattcaggatcatcgagagctgccagctcttcagattgtgacagttctctagcatcctcaatggcttgatatgcagagtcaactaatgttttgctttggcctctcgtcgcagctcctgttgttttctgcgctgtttccgccgctagttccagctgccgcttatccgtaaagccagtctgatcctcattatgaaattctgaagtcaccaaaaacacctccgccattattttgcagagtttttttgaaatttatgtaccaaaatagaaaagaaaataaaaataagccgatataactattgaaccagaataaataggactgttttactatttgaggtatcttgatagagaaggggaacgcagctatggatgataaagacttgaagttgatccttcacaaaacatttatagaaatatacagtgatttagaagaactggcggatatcgcgaaaaaaggaaaaccgtcaatggaaaagtatgttgaagagattgaacagagatgcaaacaaaacattttggcgattgaaatccagatgaaaatcaaataggagaggcgaatgcctctcctctatttgtcatctcatcatcatgtattgagtttagagttttacaacattagaagcttgaggtccacgattaccttcgacaatttcaaaagaaacttcttgtccttcttctaatgatttgtatccttctccttcgatagctgtgaagtgaacaaatacatcgtctccgccttcaacttcaatgaagccgaatcctttttcgttgttgaaccattttactttaccgttttgcatattgcttaattcctcctagtactgtagcacccatgtgctaaaaaaaattttgtcatcatttaactttgattcattgttaaatgatggttcaactatacaccatctgggagcacccgtcaagttgcgaaacggcttatttttcaaaagaaggtcaagttccataaaaaaaatgtaaccgcttttattgatggctgaatataaataaaaagagcacacgattttcgtatgctctcaagtacgccattacgatagcactttggctttttgtttggcagtcatcatttctgattccttcaggatatcctctaaaatcacttcagaggagtttgctaaatgaaggtccttaatgtttttcttcatgcgatgcaaggtatcttcatctgcaagaagggaagtgactgattcgagaatctcttcatgacggttcacaacgatggcagctccgcggtcttcaaagaagtttgcattttctttttcctggccaggcacgggtttgtacagaatgacaggcactccaatggctgtggcttctgtcaaagtaatgccgccgggcttggtaatcatgcaatctgtgatccgaaatagctcatcaatgcgctccacatagcccagaacttttaatttgtcaccattttccgcctcaagcgcactcaaagattcttttaaagccgtatttttcccgcacacgacaaccacttgcacttggtcatccttgacaaggttttcgcacagctcttttacgttctttaatacaccgtgagcacctgccatgatcagaagcacttttttgtttggtgaaagattgtactttttatatatcgggccaaccggcatggattcttcaaattgcggcctgattggaattcctgtgatttttacattgcttggatgagtgccgatctccagcagtttttccttcacgtaatctgttgccacataatatttatccacgttttcgtgaacccaaattttatgaagacaaaaatcagtcataacgttgaaggtaggaatgactcttccagttcggcgtctgtattccggcacgacgatcatcggaaatgtattaataataatatcgggctgatgttcatcgacaagttcgcccaatcttttattacccattttaaagtaaatattgaatttacgtttattatagattttgtcaactccgtaataaaacaaacgataaaactgtttcccgattgagaagctttttaaataaaggtattgagttacctctgaaacaatcggatttgactcttggtacaaattagaaactgttacatgctgaaagccgagccgtacacattgttcataaagtgttttggctacctgcacatgtccatttccgtaatttgcagtcaaaattaatactcttttattggtattcaagtaaattcacctcaatgtaatcaacaacaagcaagcttcatgcatcgtaaggagttattgtctatacataaacataacacaaatacataatcgaattattaatgcagtgaaaaagttaagctaattttaaatgatttggattccagtattttaaatttttgttatacgcagactgaatcagatgtattttatcatattttttgctcagcgtatcactaaaaaaagaaaaattagtcccattcataaggagtttcttggtaaacgtaataattcagccaattcataaacaataatgtggcatgcgctttccagcgattcactggctcgttgctgccttttgcaaaataatgtttaggctcctcgacagtagaaaggtttcgttccaaatctctttcatactcttgaagaagcgtatttgtatcatattcagggtgccctgtcaaaaagacttgtttttcgtcttttgacacaattaagcaaaccccggcttcctttgatgcggtaagaatgtttaaatcgggcactgcttgaagctgttccatatttatatctgtatgccgggaatgcggcacgtagtatagctcgtcaaaacctcttaccaatctttcgtgttttgaaagaacggtatgttcgaacacaccgaagatttttttcggcatttgaattttttcaacaccgtaatggtagtacaaacctgcttgagcaccccagcaaatatgcaaggttgaagtgacatttgttttgctccactccatgatttccttgagctcttcccaatatgaaacctcttcaaacgccaaatgctcgatcggcgcaccggtgataatcatgccgtcaaacctcttgtgacggatattggaaaaagtcgtgtaaaattcgtcaaggtgttctctcgcagtatttttcggcgtgtgtgtgcttgggattaaaaatgtgaaatgaacctgtaaaggcgaatttccaagcaatctgagaagctgagtctctgtttggatttttttcggcatcaaatttaatataataattttttgcggccggatatcctgatgaaatgctctgctttcatccattacaaatatatgttcactttcaagcacctgttttgccggcaggtgtgttggtatattaataggcaacgtgccacctccattatttccccgtttaattttcttcattataggaattttcacgccaattttcaatctatctatacgtgttgagggggaaacaacagaaaactctttaaataaaacgcactgacacgccttttggtttcacagtaaaatgattttcaaagatgtcagagggaattgtaatgttttatagaatgataagataaaaaatgagccatatgaattgataatgaacggacgctcatatcgttaggtttcttatgagttcttaattgatgtttacattttgaattgcgatttaaaaaaggtaaaataatcagcactagggacataggagggacttacatgtctatttatcatatgaaggtacgtacaatcacagggaaagacacgacacttcagcctttctcaggaaaggtactgatgatcgtgaatacagcaagtaagtgcggttttactccccaattaaagcagctgcaggaattatatgatacatatcagcaggaggggctggagatcttagggttcccctgcaatcaattcatgaaccaagagcctggtgaagaggctgacatacaggaattttgtgaaacaaattacggtgttacatttcctatgttttcaaaagtggatgtaaacgggaaaaacgcccacccgctgtttgtgtatttgacagaacatgcgaaagggatgctgggaactaaggcgatcaagtggaatttcacgaaatttatagtggatagaaatggagaaatcgttggccgttattcaccaaatacaaatccgaaagagctggaaaacgatatcgtgaagctattatagcaataaaaagagggtgtttttgtgaaggaattgaagcaggcagagcaaatcaggacatgggttcaatctatcctgactgacgaaagctctggacatgactggcatcatgtatcaagagtagcagatcttgcagcgtatattggagaaaaggaaaaagcggatttgttcattgttgaaacggcggctttggttcatgatttaattgatgtgaagctgcctgacacggtcaggctttctgtgagcgatgtatatgatcagctcgtttttttcggagtaggaaaagagaatgctgacagggtgattcatattataacaaggatgtcctttcgggacagggggaaattggcgaaggagccgctctcaattgaaggaaaagctgtacaggatgctgacagacttgatgcgattggtgctgtcggcattgcgagagctttcatgtttgcgggcgcaaacgggcatggcctttatggagatgagcaaagcgcctacgctcatttttttcataagctcctgcggctgaaagatatgatgaatacagacactgcacgggaactggcagaagaaagacacaattttatgcttcagtttgtccgccaattagaaaaagaaatacccgggattgatgccaaaacgtcgtaatagaaggcttggagcgactatgatagaataagtcacagatatgctataggaggacgatcatgaagataaaatcaattgaacctacaccaagcccgaatacaatgaaagtcatcttaacggaagagcttccggcgggcaaaagcaataactataaacctgagcaagcagaaggcgcaccgcctgttatagcggaaattcttaaaatagatggagttaaaggggtatatcacgtcgcagattttcttgctgttgaacggaatgcaagatacgactggaaagacatattaccgcaagtccgcactgcatttgggatggaaagtgctgaaagcggagaagaaaatcgttctgatcaagaatcttttggagaggtaaaagtttttgtgcagatgttcagcggcattcctatgcaagttaaattaaccgatggagagcgggaagaacgcttcggcttacctgaacgctttcagaaggcgatcttaaaacttagatctgaagcttccaatgttgtgtttgagcgggcttggaaagaacaaggtgtcagattcggtgactttgatgaaatcggccatgacgtgacagaagagcttcaggcggcatacagtgatgaacggctgaaacgactgactgaagcagccgctcaaggaaagggcgaatcaaaacaaactgtacagcgcaaagcgtataaagtaacgcttgacatgctggatgatgaggactggaaaaagcgttatgcacacttggaacagatggatccgaaagaagaggatatcccggttttacagaaggcattggatgatccaaaggtgtccatcagaagacaggctgttgtgtacttagggatgattgaaacacctgatgttcttcctctattgtataaagcacttgaggacaaagctgtatcagtcagaagaacggccggagactgcctgtctgatatcggcgatcctcaagccattcctgctatgatcaagtcgttaagcgactccagcaagcttgttcgctggcgtgcggccatgttcctatacgaagtcggggatgaaagtgcaattgaagctttgcgcgctgccgaagatgaccccgaatttgaggtcagccttcaagtcaaaatggcgcttgaacgtattgagcatggagaagaagcaaaaggttctgtttggaaacaaatgacggaaagcagaaaaaaaggcgaatagaaataaaaaaggtgcagatcatgcaccttttttatgtgaattcactttttataaaaattatttcgaatattgttgaaaaatatccgaaaactatttatagtaagtaacaatattaatagttggagggttcaaatcgaaagaaagctatataaatataaaaacacgaaagaacaaaacaaggtgagggcggcctgtatttatcttatttgcaaaaacagcccataaataaactgaaaattgtcaaaataaaatccaatcaaacaattgaaagaatttaggaggatcaccatggcagaattacgcagtaatatgatcacacaaggaatcgatagagctccgcaccgcagtttgcttcgtgcagcaggagtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagtgacgggcgaaaaatctctctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgccttgccgggtaatggaaccattctggcgacatctccggaacgcaaagagtttgtgagaaaatcggctgcgcaattaatggaaacgattcgcaaagatatcaaaccgcgtgatatcgttacagtaaaagcgattgataacgcgtttgcactcgatatggcgctcggaggttctacaaataccgttcttcatacgcttgcccttgcaaacgaagccggcgttgaatactctttagaacgcattaacgaagtcgctgagcgcgtgccgcacttggccaagctggcgcctgcatcggatgtgtttattgaagatcttcatgaagcgggcggcgtgtcagcggctctgaatgagctttccaagaaagaaggagcgcttcatttagatgcgctgactgttacaggaaaaactcttggagaaaccattgccggacatgaagtaaaggattatgacgtcattcatccgctggatcaaccattcactgaaaagggtggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcggaccaaaagtggcattgattacggacggacgtttttccggagcctcccgtggcctctcaatcggccacgtatcacctgaggcagctgagggcgggccgcttgcctttgttgaaaacggagaccatattatcgttgatattgaaaaacgtatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctagatagctggggacactttcttttattttaaggtgtgaacatttgaaatccggccctctctatagtatcctttacttcagatgaaggatactagagggggctttttttatgtcaatggcttatgaagaatacatgcgccagcttgtcgtaccgatgcgccgcgagctgactggagcaggttttgaagagttaacaacagcggaagaagtagaaaactttatggaaaaggcagagggcacaactcttgtagtcgttaactctgtatgcggctgcgcggcaggccttgcgcgtcctgcggctacacaggcagtcctccagaatgacaaaacacctgacaatacggtgactgtatttgcgggccaagataaagaagctactgcgaaaatgcgtgagtattttactggccaggagccttcttcaccatcaatggctcttttgaaaggcaaagaagtcgtacattttattccgcgtcatgaaattgaaggacacgatatggaagaaattatgaaaaatctgactgctgccttcgatgcgcactgctaaatgcccgttttccgggcattttctttttgggagtacagaagatgataacaacaagctatagaccgtctgaacacaccataaaaactgcaaagcagctttctaaagagctaaatatgccatactgcggccggaataaacaaacggttgaacacctgttgaagtcagctgaacgtgatttgctagtggtcggcaaagagcggtttgagctgtatacgaaacaaggtgccaaattcttttttcatccgaatacagcgatgttcagagccaaacgcttcttgcagggggagaaagagcctatgcttcgggctgccggcttatctgaaggggatgcgtttttagattgcacactcgggctggggtcagatgccattatcgcaagtatggcagtaggcgaaacgggttctgttgttgggattgaaaaaaaccatcttgtgtctgttttagtgaggacgggactgcattcatgggaaacgggtatagaagagcttcaagctgcgatgagaagaatccaggtgaagaatggtgattgctttgaacacatcaagcagcttcctgacaactctgttgatgtggtttatttcgatccaatgtttcatgaacctgtagaaacctctgacggcatcgcgcctttacgtgatttggcagaagattccgttttgcacgaaggatgtatcaatgaagcggtacgagtcgccagaaaaagcgttgtgctaaaagaccactggaaaagcccgcgatttgaacagtttggttttaacgtcatgaaaagaaaaacagcactgttccattatggcgtcattcaaacaagcccgtgattcatatcacgggctttctgttaatcggtgacctccatgacgacaaagtataacaatgttaagagtgaaactgtggcaaacagagcgtcaatcatgcggaaagcctcctttcatggaatattgtaagcgtttttacacaaagtgcatagcaacgaatctcctaatttgcatatcagtttcatatagtacatgacttgcatgttttggatgtgctaaaataagagaaacatgacaataaaatagagaggaataagcagtcatgaaattgtggatgagaaagacccttgtggttttatttaccattgtaacgttcgggctcgtatctcctccggctgcccttatggcggacaagccttccggacagccgagcagtcttgagcagaatgattacaccgctttttatgatgagcatgacctgtacgatgatgagtcggatgacaggcgagatcctgaactgctttttcaatcgtacaaggaacagctccttgacagcgctgaggatcagtcctttttaaaattcggcagcagaatcgctcctgtcattgaggatgactatcggaaagagatcctgccaaaaatcgaaaatgtgattagtgattatttagcgacattgcaagatgatgaggcgtaccaagatgttgtgatctcaagcatgccttcagcgggcaaaacggaaaaaattttcaacgtttacaatcggacaactggagaagatcttctcagattccatgtgcgaagagaccacccgcctcatgacggctactggtttaattttcattatcatacagcagaagatgggtttcaatcacatcatgagcttgggagtatttactgggaccgcaacacgcctcccaactggatgagtgcctaaaggagatgccattagacatgaaaaagtacacaatgaatgaaatggtcgatataacaaaggatatgctgaacaaacggggcgttatgatagaagatattgcacggattgttcaaaaacttcaggaaaaatacaatccaaatctgccgctcagtgtttgcatggagaatgtagaaaaagtcctgaacaaacgtgaaattattcatgctgttttgacaggccttgcactcgatcagcttgcagaacagaaggttctccccgaaccgctgcagcaccttgttgaaacggatgaaccgctttacggcatagatgaaattatcccgctttccatcgttaatgtgtacgggtcgatcggtttgaccaatttcggttatttggataaagagaagattggaattattaaggaacttgatgaaagtccagacggtattcacacctttttggatgatattgtggcagctcttgctgcagcagcggcgagcagaattgcacatacgcatcaggatctgcaagatgaagaaaaagaacaggatgaaaagcctgtcgtcagctgactataaaaaaatcatttctgggttcagaaatgattttttattgtgttacactactagaagactacttttaaaggatgaaaaaaatgaaacagtttaaggatttatgtagacatgttttagagcaaaaaggggcggtaagcgtatgatttcattcatttttgcgatggatgccaacaggcttatcggcaaagacaatgatttgccgtggcatttgcccaatgatcttgcatactttaagaaagtaacatcgggccattcaatcattatgggccgaaaaacatttgaatcgatcggacgtccgcttccaaatcggaaaaatattgtcgttacctcagcgccggcttcagaatttccgggatgcacggttgtcggttcattaaaggatgtactggacatttgttcaggccctgaagaatgctttgtgatcggaggggctcagctctatacggaccttttcccttatgcggacagactgtatatgacgaaaattcatcacgagtttgagggtgaccgtcacttccctgaatttgatgaatccaattggaaactggtttcttctgagcaggggatcaaagacgaaaaaaacccgtatgattacgaatttctaatgtatgaaaaaaagaattcttctaaagcgggaggattttaattggttcgctacagccttctagtggtttatattgtgtatatgctgttaaaaaatatgaaacaattatttaatcaagcaatgcttgatccccgtctgtcatacaaaaaacagatgactcttgtgtacgaacagccaaaggcgtttttggaaggctgtatcggcatctccggttcagttgtgacaatccatcagccagagccaataccacaaggtcctattttgtatgtgcatccccgtttgcgtttggctgaactggccttaattgctggatatattgaggaaccggctggctttatcgccaacccaaaagtgttccgcttgccttttatcgggcaatggctggatcggatggatgtgatttcagacggtgattcagaaaaggtatatgaagatgtgacaaaacagctggaaaagggacaaagcctgattctttcactagatggttctattgatcctatagaacttgcggcccgctatcatcttccgttggtgatggtggaaacgaaaggaacagataacatgcaaaagggctcgttttttaaacgcttaaaaccggcagacattgaattgtccttttcaaaagcttatatacctgccaatgaaaaacaattacgtgcataaaaaaagcgcagtcgtgaagactgcgcttttctgttactgttacgaaaggaacggcacctttacacaatagaagagcacgcagaaaaacatggcagcgctcccgcccaatacaaagctgtgccaaatggcgtgatggaaggggatctttttccaaatgtaaaagatggttccgacagagtataaaatgccgccgagaaaaaggaggctgaatcccgctccgcttagtgaagcatataaaggtttaactgcaataatcatcagccaccccatgactaaatacacgaaggttgacaataggataaaccgtttcacaaagaaaattttaaaaacgattccgcctagggcaagtgaccatacgataaccaacagggtaaagccgagtgtgcctttcagcggcccaagcaaaaaaggcgtgtaggttccggcgatgagtacgtaaattgcgctatgatcaataatctccaaaatgtccttcgtttttttatgtgtgatgctgtgaagcagggtggagctcaaatataacagcagcatagagacaccgaatattgtaaagctgacaatgtcccatgcagacccgtaattagccgcaaatatgattagaaacactaatgctgggatggataagaggacaccgatgccgtgtgtaatcgcattggcgatctcttctttgattgtaaacaagtacattctcctttcgatcgctagatcatttgattttttaacgtctctataaagctcaagccctcaaaggtaatttttgtgcctgcgcgtccgcggcttttggtgacataatcttttttctccaaatagtcgagacggcttctgacctgctgaggagttaacgaggtttgggtatttttgctgtgttcagaaatgatccgtctgctggcaggttctcctttttcgttcaatacttttattgtttccaaaataaacaaaaactcagctttttccattaaagtcagcagtttcgcttttttcttcgacgtttttccgtctatcgtgcctctaatatacggcggcaggtcatatggctgaatcgttcccccgcttgatactgccgccatataatctgcagcgttttttaattccctgacattgccttcaaatgcatgcttctcaagcacgggaaaaacggagggatcgattaacaattgctgaccagaatttgagagaaaatgctgtgtcaaaagcggaatatcgctttttcgttccgataattcgggcagtgtgagcgttaaaatgttcagtctgtagaataagtcttgcctgaatgtatgttccacggatcggtctgcagaagcacagatcattcgcggtttctccgtgtctgaatcaagcgcttttaacagctgagcttgtacagaagcaggcatgcgccatacatcatcaagaaaaagggttcctcgtaccgctttttgaaaaacaccagtgtttccgttagggccaaaaagctcatgaataagggtttcttccgaatgggtgctgcaattgacgcttataaacggttcattgcttctcgaagattccaagtgtatggcatgtgcgaagtgatttttgcctgttccgatttttcctgttattaagacaggaagctccgataacgagaactgcttggcgattcgcttcgcttccaggaaagtttgatgttctccgattagatgttgaaatgtattgagttttggtgcactattcatcaattggctccttttggttctaattggtttcattatatcatgccttttggttgaaaacaccctttattttacgatcatcttttttcttgactctgcaggataatggttgaacagaagttaccacaagatgtggtggacatagtctgtatttttttaataattaaataaaaataattgtcttattttttgaatattcatgttataatggcatattaaatagggatttaaaacaagaaaggaatctgtacatgaaaccgttgcttaaagaaaactctctcatccaagtgaaagacattttgaaggctcaccaaaacgtaaaggacgttgtcattcacacacctttgcagaggaatgacagactttctgagagatatgaatgcaatatctatttaaaacgcgaagacttgcaagttgtcagatcttttaagctcagaggggcttatcataaaatgaaacagctttccagcgagcagacagagaacggagttgtgtgtgcaagtgccggaaaccacgctcaaggtgtggcattttcgtgtaaacatcttggcattcacgggaaaatttttatgccgtctactacaccgagacaaaaagtatctcaagttgaactattcggaaaaggatttatcgatattattttgacaggcgatacgtttgacgacgcgtataaaagcgctgctgaatgctgtgaggcggaatctcggacgtttatccatccgttcgatgatccggatgtgatggccggacagggaacgctcgcagtcgagattttaaacgacattgatacagaaccgcattttctttttgcaagtgtcggaggcggcggccttctctctggggtaggtacatatttgaaaaacgtgtctcctgatacaaaggtaattgctgttgagccggcgggagcggcatcctactttgaatcaaacaaagctgggcatgtcgtcacacttgataaaattgataagtttgtagatggtgcggctgttaaaaaaattggcgaggaaaccttccggacgctggaaactgtcgttgatgacattctccttgtgcctgaaggaaaagtatgtacatccattcttgaattatataacgaatgtgcggttgttgctgaaccggctggagctctttctgtcgcagcgcttgatttgtacaaggatcaaattaaagggaaaaacgtggtgtgtgtggtaagcgggggcaataacgatatcggaagaatgcaggaaatgaaggagcgttccttgatttttgaaggtcttcagcattattttatcgtcaattttccgcaaagagcgggggcgctccgcgaatttcttgacgaagtcctcgggccgaatgatgacattacaaggtttgaatatacgaagaaaaataataaaagcaatggacctgctcttgtcggcatcgagctgcagaacaaagccgattatgggccgctgattgaacggatgaacaaaaaaccgtttcattatgtagaggtgaacaaggatgaggacttgttccatttgctaatctaatttttttacacaaccgcgcaaaatgacagacagcccggctggcatcatatataatagaagaaaaacaaaaaagaggattgatagcttgttactcaaaagcctagagttcaaacgcgatgacgggattcaggtgaaagtgacagaaatacctgtattaaaggaagatgagcactatttctttatgttacatcaccatttgcaattctacttaaaagaagtgttttcatcaaacagcagggcaaaagtgtattctttccgacattatatgaagcgccggatgaagtgggcagattatcaggctgtatttcatcaagaggtgttaaagcacaacgcgtaacatgccgttttttacctgcatgccctcctttgtaatcgttaatggggaggcatgcaggattttttttgctcagtatcgaatacaaacatgggacagtaaggacggttttagaaagcgtttttatgctggctggaaaggatggatgtcatgaaggttatcaaggggttaacggctgggctgttttttctgtttttgtgtgcatgcggaggacagcagattaaagatccgctcaattacgaggtggagccttttacatttcaaaaccaagacggcaagaacgtttctttagagagtttaaaaggagaagtatggctggcggattttatttttaccaattgtgaaactgtatgtccgccgatgaccgctcatatgaccgagctgcaaaaaaaactgaaggctgagaacatagatgtccgtatcgtatcctttagcgttgatccagaaaacgataagccgaaacagctgaagaaatttgccgcaaactatccattatcttttgataactgggatttcctcacgggatacagccagagtgacattgaggagttcgcacttaagagctttaaagcgattgtgaagaaaccggagggagaggaccaagtcattcattattcttctttttatttggtaggcccggacggtaaggtgctgaaagattacaacggagtggaaaatacaccgtacgatgatattatcgccgatgtgaagacagccagtacactcaagtaagctaggagactgggcatttgcaaatcttctaaaacatgatacactttccactagtagaatgggaaggagcaacaagattgaagctgcgcattttttcaatcatggccagtttgattttgcttcttactgcgtgtacgagcatacgtacatcatctgagggaaaacaaaaagcccatgaaacgaaaacaaaagaacacattgtcatagcggctgtcggagattcgctgacagaaggagtcggagatcccgacggaaagggatatgtcggcaaggtggcggattctatccggtcagataaacaagtcaaaacggtcgacgtgaaaaattatgccgtaaaagggaaccgttcggatgatttattagaaaaactaaaagataaaaaggttcaaaaaggcataaaggacgcagattatgtcttttttacaattggcggtaatgatttgatgaaaatccttcgccaaaactttctgcaattaaccgttgaaccgtttcaggaagcggaaaaaccgtacgaaaagcgctttgaaaaaatcatttctgaaattcgcgagctgaatgatcacgctgagctgatttatgtcagcatgtacaatccgtttacgtttacattatcagaactaaatgaaataaatggtgtcgtcacggattggaaccatattgctgaaaaagagctgaaaaaagataaacatgcaaaaatcgttcatatcgaagatttgttcaatcaaaaaagtgacagcagccgaatttctgaggaagatgattttcatcctaatggtacgggttattctcttatcgcaaagcgcgtctatcaagccattaaaaaagaaggattaccgaaagagtagggtgacagcatgaataagtggaagcgactgtttattatattgcttgcaatcaattttatcctcgccgccgggtttgtggcacttgttttgctcccgggggaacaggctcaggtgaaggattcatctgagagcgagtatggatttcaagtgacaagcacaaaagaatcattagctgcgtttgttaactcatatttaaacgacaaagcatcaaacaagcttgattataaagtagagattgatgatgatgttcatgtcgcagggaaaatcaaggcattttccacgtctattgatgcgtttatcgcttttgagccgactgtgaaaaaaaacggtgatgtagagctgaatgtcacgaaattttcgttagggaaattgagtataccaattagctttgtgttaaattatatggacagcttttatgaattgccgtcatttgtccatgttcaccccggagataaaagcattgaagtgcgtttgtcagaaatgcctttaacgaatggaatgtatgtcaaagcggataagataaatttagaaaaagatgaaattgagttttcctattaccatcctaaacaatagaggtgactgaaaatgaaaaggatttaccagtatttcagtttattatcctttacattttccctgtacttcggctggcttgcttatcatcatctggctgctgaagacatggatcaaatgtatttgaatgtttcctattgtgccttgttcctaagtgtgatggtgtttacattcggtatgcgagaccgaaaaaaaaaccgataagtcatgaaaaaagagacatgaaacaacgtctcttttttcgtgcggtccgaagaaaatttgagaacacaaggagaaaagatgaaagcatacgattttacacaggggaacgtgctgaaacagcttgtactgttttcaatgcctattatgctcggaaacgcattgcaggtttcctttcaatttatagacagcttgtggatcggcaatttactgggggcaaaggcccttggggcagccgcggtatcaagcacgattgttttgaccgtgctgtcttttattttgggccttaacaatgcgacgttaaccattttatctcagcaaaaaggaaaagatgatgtaaaaggaatggcgtcgtatattaacgcttttgttgttttattaacaggcctaagcatcggattcggcgcggccggtttttttctctcagagcttttgctgcgtcttctaaaaacgccggagtcaatgataccgcttgctgagacgtatttacagattcaatttatcggcattttatttttgtttggttataactttatcagtactgtgcttcgtgcgctgggcgacagcaagacacctctccggtttattgcgtttgctgttgtactgaatacagtgcttgcgccgctctttatttctgtgttccgcatgggaatagcgggagcggcttattcaacgattttgtcacagggcattgcgtttttgtatgggttgttttatgtggtcaaacacaagcttgtgccattctcaattccgagaatgcccaagtgggaagagtccgcgctgattttgaaactcgggattccggcaggtctgcagatgatggtgattacaggcggtatgatggcgattatgagtgttgttaactcatacggggatcacgtggtatcaggctttggcgcggtgcagcggcttgatagtatcatcacgcttccagcaatggctgccggtacggccgtcaatagtatggcagggcaaaatattggaatcggaaacgaaaaaagagtgggaacaattgcaaggctaggtgtgatagctgttatttcctgcatgctggtgattgcggttatgatttgggtatttggtaaatatctcataaggttatttatcagtgagcccgatgcggtcgcatttggtgaacaatatttgaagtggatcgcgtttttctacccttttattgggattaattttgtgctgaacggaatcgtcagggccgcgggagcgatgctgcaggttctggtattaaatttgatctcgttttgggtgttgagatatcctttcacagctctattttcagcttggcttggacaaaaaggaatcgggcttggaatcggaatgagttttttatttagcagctgcgcggcatttttgtattatagatatggccgctggaaagcaatgaagctgtttactgaaaaataagtgaagcactgcgaaaagcacatacctatatatcggtatgtgctttttttcaccgttttttatcaagtttgctgaagagctcgattaacgtggcaagttcagcatcagtgtagcagtcaaagcgtttaaagaaatattccgtttttttctcgttaaagtgctgaaggactttttcgcccgcttcagtgatatgaatgcggatgatgcgtctgtcttccttcgatctgattctcgtaatccattccttttctaccagcgcatctgtcacagccgtaatgtggcttgccgatacttctaaaataggcgcaaattcagtgacttttttaggcccttgttcactgaggatccgaagaatggtgaattcattccgcgacagctctttatctaaaatttcattgatttcattgcgtatttgtttaaagactttacggagtaaagtttccatatcgtacatcatctgtgttcttactttcaaatttgtgaacctccattacataagcatattgcttaaaacctatagattttattgaaaagcagaatcattttcattctatttttacatgctataatataataataccacgtattaacaaaggaggcaccagtatgtctgaaaaaaaagaaatcgccacatttgcaggaggctgtttttggtgtatggttaaaccttttgacgaacagccgggaattgaaaaagtggtgtccgggtatacaggcggccatactgaaaaccctacgtatgaagaggtgtgcagtgaaacgacgggacatcgtgaagccgttcaaattacgtttaatcctgatgtattcccttatgaaaaactgcttgaattattttggcagcaaatcgatccgacagatgccggggggcagtttgctgatcgcggcagttcctatcgcgcagccattttttatcataatgataaacaaaaggtgcttgcggaagcttccaagcaacgtctggctgaaagcggcatctttaaagatccgattgtaacggacattttaaaagctgaacctttctatgaagcggaaggctaccatcagcatttttataaaaagaatccagcacattatcagcgctaccggacaggttccggacgagcgggatttatcagcgagcattggggggctaaataaatggcgtacaataaagaagaaaaaatgaagtcattaaatcgcatgcaatatgaagtaacgcaaaataacggcacggagccgccatttcaaaatgaatattgggatcataaggaagaagggttgtatgtagacattgtgtcaggcaagccattgtttacatccaaagataaatttgattcccactgcggctggccaagctttacaaagccgattgaagaagaagaagtggaagaaaaactggacacgagccacggcatgattcgcacagaagtaagaagccgaactgctgattctcatcttggccatgtatttaatgacggaccgggtccaaacggacttcgttactgcataaattcagcagcgctgcggtttgttccgaagcataagctgaaagaagaaggatacgaaagctatctgcatctctttaataaataaactgttaaaaacaggcctgcctaatggatagacaggcttgtttttatgcctttttctcttgatgcaattcttcaataatctgagcaattctttctttcgtaatgagcggggcttgatctgattgatacccaggcagattgactttgcgaaagtcaggatgtttttccggctctggaaggattgcataaaggttgccccattcatacagtgattcaatttcatgtggagatgttaattcttcgtgaagcttttcacctggacgcttgcccacttctactgcagccggccgcgggagcccgtgctgcgatgcatattcttcaaacccatgaatcagttcttcaagtttcagtgattccattttgaaaataaaggtttctccgccttttgtaatagcagccgattgtaatgtcaatgtagctgcatcgtctattgacatgaaaaatctggtcatgtttttgtctgtgatggtcagaggttcaccctccatcatctgttcaaataatatggggatgaccgaacctctggaaccgagaacatttccaaagcggaccgaacaaaacaaggttcctttgttttggacgtggcggtttgcttgatgaaacagcttttcagataacagcttggtggcacccattgtgttcacaggagatacagctttatctgtactgatattaatgacatgctgcactcggtgtgaaagggcagcttccaccacattttgtccgccgatgagattggtctggatcgcttcaaatggatggtcctcacatgtcggaacctgtttcagcgcagccgcgtgaaagacgatatcgacgcctttcatcacctgattcacccttctgtgatcgcgtacatctccgagtacaaataatagccgcttatcctccgcatacttttggctcatgacatactgtttactgtcgtctttgctgaatacaatcacctgtttaggtgtaagcagcaaaaggcgtttgacaatttgactcccgattgaacccgttccgccagtgactaaaactgttttgttatggaaaaatggttttagttctgctgtttgctgtttaggcatggcttatcctccaactctcgtttctctaccatgcatcatatgttcaactttgtaatcgaattaatgaaagcaaccaataaaacaaaatttaggggaatgatcatgtcacaaagtgttcttttttaatggaaaatggaaaaacggacgtaactagggaataacaaaactaaaaaaacaatgtactaaatattcaacatatttttatttcgctccgcaaaagcaaagctggcaaagtcatctcacgtacctctttggggaataagttgtttatgagtcagaaaccctataaaaaaaggttcattttcctcacggtaatcacatgtatatattttacaataatagtgatagtgataaaagaggaggataccaaatgaaggtttcaaaaacaatgctgctaagcactgccgcgggtttattgcttagcctgacagcaacctcggtgtcggctcattatgtgaatgaggaacatcatttcaaagtgactgcacacacggagacagatccggtcgcatctggcgatgacgcagcagatgacccggccatttgggttcatgaaaaacacccggaaaaaagcaagttgattacaacaaataagaagtcagggctcgttgtgtatgatttagacggaaaacagcttcattcttatgagtttggcaagctcaataatgtcgatctgcgctatgattttccattgaacggcgaaaaaattgatattgctgctgcatccaaccggtccgaaggaaaaaatacaattgaagtatatgcaatagacggggataaaggaaaattgaaaagcattacagatccgaaacatcctatttccaccaatatttctgaggtttatggattcggcctgtatcacagccagaaaacaggagcattttacgcattagtgacaggcaaacaaggggaatttgagcagtatgaaattgttgatggtggaaagggttatgtaacagggaaaaaggtgcgtgaatttaagttgaattctcagaccgaaggccttgttgcggatgatgagtatgggaacctatacatagcagaggaagatgaggccatctggaaatttaacgctgagcccggcggagggtcaaagggacaggttgttgaccgtgcgacaggagatcatttgacagctgatattgaaggactgacaatctattatgcaccaaatggcaaaggatatctcatggcttcaagtcaaggaaataacagctatgcaatgtatgaacggcaggggaaaaatcgctatgtagccaactttgagattacagatggcgagaaaatagacggtactagtgacacggatggtattgatgttctcggtttcggacttggcccaaaatatccgtacgggatttttgtggcgcaggatggcgaaaatatcgataacggacaaaccgtcaatcaaaatttcaaaattgtatcgtgggaacaaattgcacagcatctcggcggaatgcctgatcttcataaacaggtaaatccgaggaagctgaaagaccgttctgacggctagaatagaaagcagcttgtgcagctgcttttttctatgaataaaaaaatcgttcatagcaatgaacgatttttcaagaaagcgccagatgaatcgcttttagttttgcaggaagctcatcaaacgtaaatgcgggtacggtctctttataattggctgctgcagctttttgccgttcttcaggatggttgatatagaaagcggctttttccttaaagtcgttcatgccgtgataagaaataaaggatgaaaaaggatgcgccgcgggtaaatctgttaattgaaatgcttcgcatgcagcaatatcaaacgttcggttattaaaactggcatttttgatgcgcatagtattttggttgaaagcaaaatgatagggacgatgcgcattaattacgatgtctgccccattataataatgaacggcctgttcgggtggaacccatgcgctgacgacatcaatatgcggctgtttgagcacttttttaggcagatattttctccattccttgccgattacccgaaccgtgaatggcagatggaccgcttctttcataagctgaacccgattagggtaagggtagccgatgattaacagatttgaatgataggattgtttggtgcccatttttttaaacagccgatgattaactggtatcggaacataatagacgtgctggtagccgagcccttgataatagagaacggcattttgttcaatcgttaatatggcgtcagcgagcttgattacctgtaggctgatatccatataaaatgggtcttcggtcagccaaacatatacggggatacccttaccctttaaccaggtcagccagtcgtgaggaacgcggtctccaaccatcaagagtgcgaagtccggctgaaacgtttcgatcttcaccaaagattctgcttcaagtgtatctgcagacatatactctgtatgagtgttccgaaaacattcttcagcccagcgatcaaaataacaatatattcctccgtatcccgactggatatacaagactttcatcggatgttatgaaaagaacgtaacgctttctactttgtctacatcaattaatgttgtagcttggcctgctggagtgacggaactttcctgtgttacaaatacgatcccgtgaacctgatcgaaagcaacgaagacaaccggcccgatcatgtctcctgaatcggttacaatgctgattgtcgtgcctggcgtaactctggcaaaaatccatcttgccggaagggaagggtctaaaagagattctgccgtaaccatctcactttcatctactctttgatcgatggcagcttcaagcaagtctttaaggttactatccatgttttctcctccttctgttgcagttggaaataaagggcttaaaacggctttaattaaatccttttttaactgtgcattttcagagctcattacacacacctcctattcgatagtgaactcacgttaatcatattcttcgggctgttatttggtatgagtcgaacgccgtacctgatctaattttcatctatttaaggaaaatgctgattttttaatggagtggacatagcctataccataaatcggagtcgcacatattgtgaaacagagataaggataagggagagggatgatttggatttagagaaacaagtggatcgagaagaaaatctagatgaactgcattttattttgcttttgctgattctgctgatacgtcaatcgtcttctgaaggaaatccatctgacctcagacgccagcttgtttttgcaaaagagctgggcgtaccggtttcaaaagtcaatttgattaacggagatacacttcaaaatgtcagtaaaagaagttctgactgatttggttattttccaaaacccgttaaataacatgagatctcatgtttcactctcaagtgttgtaagctggggtgctttttaaaagatgacagaggctctgcttgctgcggagccatttttatgtttgacggcgggaggcggtatagatgggagagaaagtgtctattattttaacaagttacaacaaacccgattatttgaaaaaagcgatcgaaagcgtgatacagcaaacgcatgatctttgggagctttttatcatggatgatcattcgaatgcagaaacaactgcggtaattcataagtatcttcatgaccggcgcattcaatatcataacagtttcgtgcatcctgcagatcgattaaaaacagcccgttatgccacattaattaacagtgcgctcccatttgcagacggcgattacatttcctatcttactgacgacactgtttatcatcctgagcggctgagccgtatgatgcaagagttttcacataagcctgaagcgcaggcggtctattcaaaacaaaaagttgtacatgtaaacgaaaggggagaggaaatctcacatttctacagaaatgccaatgcagtgcttgatcaggccgcttttcaagttgatcattgctccgttatgcatcgccgttcgttacttaatctcatccatcataaatttggaggctactgggatgatgatatgaagcattggaatcatggcgacgcaattttttgggcgagactcaacaactttacccgatttctgccgataaatgaagtattagacacaacctataaaaccccagattcatttcaaaatgcaaatcggtttctgcccgccgatttgattgacggctcttttgtaaaaggttcagatcaaaatgtgtatttttttgatcagggtgtaaggcatcctgttggagaaaagtggggttttttgtatctaaatcggactgtcgctgttccagacccatatttattccaatataggattggaaaaattttaaacattccgaattatattttagtaaaggaagctgaccatcctgcaatattttatatcgaagccggaaaaaaaaggcgaattgtggaccagtatgcgtttcaattttatcaatttcaaagaaaagacatagtgacaattggaaaagaagagatggagacgcttccggaagggccgccgattacgtggaaacgatctgaattgatcaaaaatccgcctggccgacgtctgtttttcatcgaacgcgagccgtttttgtttctaaacggcgtctttcacccgattagtgaacaagtaacaaggaagttttttttacatcagaagccaatctccgcttctttccgaaatattcagcaatttccaattggaaagccgttttatccggtgtacgatgagattataaagaaattgaatattgcaacagagtaaaggtataggtcataaaaaggagacgttcatgacaggacattattcaaaaacggaacatcaatatatattgttaacgtctgaatcggcatcgtttgatcattacagcgtatacagagatccgcagcttccgcaaattttttctcataactttgttcagctccatgatacgtttccattggagcggttacttaactttttaccctccgtaccaaagctgcttgatgcgaattatctccatttaaaagcatcgccgcagcatgtttttccgctcggtttgaagcagtcgcttgtaaaaagcggttttgtcgtcgaggatgagctactatatgacatgaagcttagtgactggaaggggcagatgggacatcctttaaccgcatgggggacggcaaaaagtctttgcgatggatcttctattatgaaaatttacgattccatttatattggtgaagcaatcgctgaacaaaaattaaaaagaaaatatcctttctatgaagcaggtataatcattcttgttgtttgttacagcgaccaggcacagaaagttcccattgggtgcggcgagctgtttatcgatcagcaagagaaaacggctaaaatcgaagaagtggcaattttagatcagtttcaaaggaagggctacggcagtatcttagtgaaagaaatgctgtccatcgccaaatcactaggaatggaagcagcctacttagtggctgcaagcactgacggtgcaactcagttttacgaaaagctgacgtttaaaaaatatgagcgggtgcatactgtatttcattatttccttacatgaaataggcgtttgcacaaaccatttgggacttggcccgcataaaatgccgtatatcgtgataagaaaggatgaaaacagcatgtatggatactctgggtacggttacggatttggctgcgggacaaatacatttgtgttaattgttgtcttgttcattttattaattattgttggagccgcttttatttgctagatgctgaaattccaaaagagccttccctattaggaaggctctttttatgtgaaaaagtttttgcggggaacgtcatgccgccatttggacactcatacaatatggtaaaaggggttttgaggtgggagcatgagcagttatttgattaagccagagattagctcggcctatccggttgtcagttatgcgaagggttcatatgtttatgatcagaccggaaaaaaatatctcgacggctcgtcaggtgcggtgacatgtaatatcggccacggagttcgtgatgtgactgagaagctgaaagaacagcttgatcaggtgtcttttgcttaccgctcacagtttacgagtgagcccgccgagcaattagccgctctcttggcacaggagctgcccggagatgtgaattggtctttttttgtcaacagcggatcagaagcgatagaaacagctatgaaaattgccattcagttttggcaggaaaaaaagcaaacacaaaaatccatctttttgtctcgatggagcagttaccacggaataactttgggagcgctttcattgtctggtttttatgaaaggagataccggttcacccatctcattgagcggtatccagctatctcagctccacatatttatcggctgaattatgagacggaagaagactttgttcagactgcagctgatgaactggacactatgatcaaaagaatcggaagccaattcatcgccggctttgtggctgagcctattattggtgctgcaggcgcagcgattactccgcctccgggatattatgagagattaagtgaggtatgctgcacacacgatgtgctttttattgcagatgaagtgatgacggggcttgggagaacaggaaggatgctcgcgacagagcattgggacaccgtacctgatattgctgtactggggaagggactcggtgcggggtatgcgcctattgccgctgccgtcgtatctgattctattattgaaacgataaaacaagggtcaggtgtgattatgagcggtcacacatatagtgcacatccttattcagccaaagctgctcttgaagttttgcgatatgtgttaaagcacggcttgatcaaacaatcagaaaaaaagggcgctgtgctgaagaagaagcttgatgaggcggcatctcaaagcggcattataggtgatgtgcgcggaaaaggactgctattaggcattgaatttgtggcagaccaaaaaacgaagaaagtgtttccgccagagcaggcggtaacccagcttattgtcagcgaggcgaaaaaacgcgggctgattgtttatccttccaaagctggaatagacagtggtgaaggagatgctgtcattgttgctcctccttttaccatttcagacggtgaaatggaagagcttatctctattttttcagaaacagttgcagcggtcgaaaaaaacttaaaaaaggattgacattaaatggcgccatttcaaaaagcaatcagcattgacacagcaattgcagatgttcgggatggatcggttctgatgtttggcggttttgggggagtcgggtcgcctccttcattgattgaagcgatattggacagcggtgtaacggatttaactgtgatttgcaatgacgccggtttcccggatatcgggatcggcccgcttattgttaatcaacgggtcaaaaccctgatcgcctcgcatatcggttccaatcctgtagccggaaaacagatgacagaggggacgttagaggttcaattttcacctcagggaacgcttgcggaacggattcgcgctggcggagcgggacttggcggtattttaaccgatgtgggcattgataatccaatggtttgcgaaaaaaaggacatcgtaacagtggcgggaaaacgatacttgattgaagaggcgctgacggctgattttgcttttatcaatgcttacattgcagatgaattcggcaatctaacgtatgacaaaaccgcgcgcaatatgaatccgcttatggcaatggccgccaggagaacctttgccgaagctgagcgtatcgttccgatgggggagatttctgaagaaatgattgtcacaccgggggtttttgttgagggggttgtacgaagcgagggagtgaagtggaaatgggcttgggagtagcagaaagagaacagattgcaaaacgcgctgctactgaaattaagcagggcatgattgtgaatctcggtatcggtatcccatccttggtaccgaactttttgaagcctgacatgcaggtcatgtttcaagcggaaaacggtgtccttggcattggagaaagtcccgaaaagggagaagaggatgcgcatttatgcaacgccgcgggatatcctgtccgcgctgtaaaaggggcgtcttattttgatacaaccatgtcttttgcgatgatcagaaaaggcaaaattgacattacgattttaggcgccctgcaggtgagccaatcaggagatttggcaaattggcttgttccgggaaaaaaggtgcctggtatgggcggggcgatggagcttgcccaaaaagcgaaaaaagtggttgtcgtcatgagtcatacagatcaaaagggaaggcctaaattaacagaaagatgtacgctgccattaactgctgcaggctgtgtagatttgattattaccgaaaaagcggttcttgaggtcgatagccatcacttcattttaaaagagctgatgaatggctcgacaatcgatgaggtgacgaggctgacagaagctgaaatcaaaatagatatgcctttttcttaagagggggaatgaggatgcaagacattgaaagaaaagtaatcgagtggcttgatcagcattcggccaaagccattcgtcttctcaaaaggctgattggggaaaaaagcacattggggtcagagtttaacgcccaagctgttgtgcttgaaaagctgcggcaatttcatatggacattgatgtatgggagccaagcataaagcaattaaaacagcatccctactttaaatctaaccgatccgattttcatgagagcccgaatatcgtggctaaaaaaacgggagccggcggaggcaggtccctgattttgaacggccatatcgatgttgtgcctgaaggaagcgtaaaggattggaagtatgaaccgtatcaagctgtcgaagaaaacggtaaaatatacggccgcggctcaacggatatgaagggaggcaatacagcccttctttttgctttagaagccctgcacgcctgcgatgtcaaactgaagggagatgtattgtttcagagtgttgtagatgaagagtgcggcggcgccggtacactgtccgccatcatgagaggctatcgtgctgacggggcgctgattcctgaaccgacgaatatgaaactatttattaagcagcagggttcaatgtggtttcggatcactgtgaagggattatccgcacatgggggcacacgctacgaaggggtaagcgcgattgaaaaaagcatgcacgttatcacagcgatacaagagctggagaaagtccgcaatgcgagaatttcagatccgctgtatgacaatatcccaataccggtaccggtgaatatcggcaccatctcgggcggtgcctggccatcttcagttgcagaccgtgtcgtcatagaagggagatgcggaattgctccccatgagaaaccagaagctgtaaaacttgaattggaaaactggctgaaggatttagaataccatgacgaatggtttaaacgccatcccgtacaagtcgaatggtttggcgctcaatggctgccgaatgatttacctgatgatcaccctttaatttctgtgctgcaatcagcctataaaaaaatgaaacagacagagccgattattgaggcttccccgtggggaacggatggagggcttttgtaccatgcaggagatacaccagtgatcgttttcgggccgggggaaacaaaaacggctcatcaggccaatgaatacattgaggttgaagccatgatagaatctgctaaaattattgcactttttgtcatggattggtgcgggcttcatacagatggggaggatgcggatgctcaagtcaataaagagtagcggtgtcacagcagttttggaccatgacggttttaataaacgaatcagagtggtccgttatgacggagccattgagaaggccctgccagatatcgtggcagcggcaaaagaagagaatgcagaaaaaatcatcgtctatgcgaagcagcatgatgagccaatgcttgtcaaacaattatttgcgccggagggctatctaaagggctattatctcggccattcggcttgtgtcatggtacgttatctgtcagaaagccgaagacaaacagattcttatacagaggaacaggagatcatcgaagccatatatcgcacagcgccccgtcttcgcaacgacagtacacccgtttttacgatgagaaaagcagaaacaaacgacatgtaccagctatcgatgctgtataaaaaagtatttcgcacgtacccaaccccagtatttgaccccgcttatattgaaaagacgatgaatgcaaatacggtgtattatatcatgcttgatcatgaccgcctgatcagcgcagcaagcgcagaaatcaatccagagcttgggcatgcagaaataaccgattgcgctgtgctgccggaatatcgcggccattcgttaacaagctttttaatcgaggcgttagaaaaagaaatggctggaaaggatatctttcatgtgttttctctcgtccgtgcttcgtcttttgggatgaatgctgtgttgtaccattcaggttatcagtatggcggaaggctgatcaataattgctttatagccgaaggccttgaaaacatgaatatttggtgcaagcaactgtaagtcaaaatatgcgcgaggaggagttcgtttgaaaaacaaatggtataaaccgaaacggcattggaaggagatcgagttatggaaggacgttccggaagagaaatggaacgattggctttggcagctgacacacactgtaagaacgttagatgatttaaagaaagtcatcaatctgaccgaggatgaagaggaaggcgtcagaatttctaccaaaacgatccccttaaatattacaccttactatgcttctttaatggaccccgacaatccgagatgcccggtacgcatgcagtctgtgccgctttctgaagaaatgcataaaacaaaatacgatctggaagacccgcttcatgaggatgaagattcaccggtacccggtctgacacaccgctatcccgaccgtgtgctgtttcttgtcacgaatcaatgttccatgtactgccgctactgcacaagaaggcgcttttccggacaaatcggaatgggagtccccaaaaaacagcttgatgctgcaattgcttatatccgggaaacacctgaaatccgcgattgtttaatttcaggcggtgatgggctgctcatcaacgaccaaattttagaatatattttaaaagagctgcgcagcattccgcatctggaagtcatcagaatcggaacaagagcgcccgtcgtctttccgcagcgcattaccgatcatctgtgcgagatattgaaaaaatatcatccggtctggctgaatacccattttaacacaagcatcgaaatgacagaagaatccgttgaggcatgtgaaaagctggtgaacgcgggagtgccggtcggaaatcaggctgtcgtattagcaggtattaatgattcggttccaattatgaaaaagctcatgcatgacttggtaaaaatcagagtccgtccttattatatttaccaatgtgatctgtcagagggaatcgggcatttcagagctcctgtttccaaaggtttggagatcattgaagggctgagaggccatacctcaggctatgcggttcctacttcatttgttagatgatgtatagtataatcccaatatcacaacaaggttcttggaggtattgtagctaatgacagaaattgctacaggtataaaaaatgttgctatgtatttacgtatttcacaggaaaagaagggtgaaaacgttgaaacactagctaaccatgaaagtatattaaaagactttgccaatagaaaaggctatgttatcgcagaaacttttaaagaggttctttcaggaggtgcttccgaactacaagcaagaccacaattacaaaggctgttggacaaccttgaaaagtttgatgctattctagttgtggaattatctcgtctatcaaggaacggtttaatttctgaaactgtacttcaatattgtaaggactatgacaaaccaattataacacctgaaaaagtgtatgatctatccaacaatgacaatgacgttctaaccttccgttttggtgctttaattgcttcacaggaacactctttaattgggaaaaggagtaagaataataaaataacaatggctaaggctggtttagatattgctggtggtgttccttttggttatagaaggaacaaggaaacaaagaagctagaaatatacgaacctgaggcagaaacaatccgttatatttttaaacttcattcacagggtttaggtagctttaagatacgtgatattttgaatgaagaaggtataaagccagctaggggaaaccattggaacttaccagctataaagcgaattattagaaatgaaaagtataaaggctggaacttttttaatgatagaaaacgtgtcaaaaagaatgggaaatggacttatgaaattgtggatactatcacagtaaaagacgcacacccaccgattattcctcctgaggaatgggataatgctaatatagaacgtgaaagacgggccaaagttgctagtcgtattaaacataagaaaactgtttctatggttagtgatcttttatattgtggtatctgtgggcgtaaattatccatacgtgccgatagaaaaacaaaaaaggtacacgttaagacttgtgattatttaatgcacgaaaacggttctaaatgtagaaataacggtgtattgctggaaaaggttgaagaagaagttcttaaaacaatcaagagatataaggaggatttgcaagaggttattgatcagctgtcagaggccgatacatctaatgtggaacaagaaataaacagtgaaataacaagtttacagcgacaacaaagggaactagacagccaaaagaaaaacttaattaaagctgttgcttcaggtgtattgactggtgaagatattcgatcagaaaaagaggaaattgaggctaaacaaaacgcagttactagcaagttagaagaattagaaagccaattacagacacttgatattgacgcaatcatagaagtgaataagcgggctatagaggcgttaaaagactttgaaaggcatagccctgagaatcaaaataacaccttaaaacgtgtgattagtcgtattctgtacactagggatatgcctgacgaaattaaagcactaacaacacgtaacccccttagaagggagtatccatttactttagaaattgaatatttaacatagaactattaggactaattttcctgacagtttttattttgggcaaaaaaaagaacctctaacagcgttaagctattagagggaaaaggaaagatacattgttattactgttaaaactttgtatcaatacaccagctatataaactggtgacattattttattaggtatcacagctatcttagaatattagagattagttctttattaaattagtgctatcctatagcaccccgaagggtaatatctttaatggttctatgccacaaatagaacagacttatccttaagccttacggggcttacgccaacttcttaaactattaacttaatttctttatctttagtttattatctttatatctctttattatatccttttgacgccccccttgtttacaggttattaaatgttacagttttgttacaaatttataaaagtgccatgaaccctacagccacaagggattgacgaattatctggctttttaagataacctgaatttgtgcatagggttttttagatcatgtgttaatcacaagaagagggattattaaacttgtgattattaaactctataaacacttgatatataagggcttttaaagtttgttaatcacaaggggaaattctgtaatattgcaggaatatagtcctttttgtcgaattgaataacttatgtataaaggagttgaaggtgtatgaaatttacattacttgaaaatggtgctgattcactaaagtcagcttatgaaaatttagaattcctaaaagaaatagctgaaggcggggaacatagattaaaagacgccgtgattttccttaatcatggtgttgaattattgttaaaatatattcttaaacaacgtagtccagctttaatgttcgagaaaattgaaccgtatttgaaggcaaaacaagatttaaaaaaaacaaaggataatcacaagactgtcttcgatatagataaaaatttaagaacagtaagtctattagaggcattaaagagaattgaatatctctgtgacattgaaattcctgaaaatcttaattcaacaatactttatgtaaataaaatccgtaataatttcatgcactatgaagtggaacttgatgataaggaaactgaatctttggtaacaaaattacaagtatgttatgaagaagcggttgaatttcttgaatctcatatagaggatttagatgattatattcaagattcacgttttgaacttactgttgaggaatatgaggaacagcaagccgaaatgtatggtgaaatggcttatgaaatgcaaaaggaagatgcttatatagattatatagaaggtgcttatgaggatttaggcgaaggaaagtggtaataatttagcatccaattagggtgctttttattttgaacattcttgtgattaaccactttataaaatcaacgtttattgaggttaataatcactatagtacttttatacactaaagggtattgatttataaggattcctaagatgggtttatcacaaggtacgcacaatgaggcaaaaccgttaaacccttgctatataaagatttcttacatttaatgattgtgattttttgtgattttaacgcttccatgccctgtttacacagtcgcctcagaaatattttttcgcacaatagaccagccaaaactagcaaaggcaacacctgttacagtgtcgcctgttgttctctatattcttttaatcgtctcttaaatgtggcaacgctgcaccctgcaaatttagcaccctcagactgtgacattgttccagcttctacttgatggatagcatgtaataaagaaccttcaattttgtatgttttgacttcctaccaaacataacacctttttctttagcgtccttaatgccttcctgagtacgttctacaatcatatccctttcaaattctgcaaaggaactcatgatattaaagtatagtccttgtgttaataaaaaaagagacgaacacactctaaagtgtcgcctcataatacaaaattagacaagctattttcaatttcctcttcagtaattccgatatatcgtaaagtgatctcagggcgtgagtggttaagaatgatttgtaaggttgctatatctttagtttgtttatagtaccagtaaccaaaagtcttacgcattgtatgagtaccaataccgtcgggaatatccaccatgttagatgctttatttagctgtctgtaggcttgtattctgctgataggcttatcacccttacgagaggggaacagccattcagtgccttccagtgtatctatataattatttaattccgtgtagatattagttaaatgtattgtacgaggtttttctgttttcccctctttaaccgctattctctttttcctcttaatgtcagtggtctttaaccttaataaatcacttacccttaatccagtattgattcctaagagaaaaagtatgtagtcacgatctccacaccacttctttagcgaccatttcatatcctctaatttatccaatgacctaataggctgtacgtcttttatctcgtcttttttgcttttcttagctgtcatttaaacccctcttccaaagtcaaaaaaaatcaacgttttgaatgtaacatatttttaagataacctaagtatatcaatgatttctattctgtccaataattacagcgaaatgaatgtaacattttgtgtaataagttacataaaaaatgacatgaagacttgataaaacaaaatatctaatttatctattttatctaaggaaatatgttgcatttatcagaaaaatcatctattatcaaattgtaagatattttagataaattggatcgaggttatattatgagtgataaatttgagggaattgtgttggaactattttcgagggtaaaatcattagaggaaaaagtcatggtattagaaaaacaaataaataataatgctgttgacaaagaagaagaagagaacaatctacaaacaagtgttaccgctaatcaagaaaatgacaaccaagaaaagatcactcgttctattgctagacaatatgttattaaccgtctaaatgaaacaaataaaggcataacagcactaaaaggtaataaagcaaaaggttcaggaattgttattcaatcgaatagtaatccaaatatggaacttaaagctaagttttattacagtaaaagtcatttagaacacgtatcatcatggcatacagttggcttcaaggatattactaataatgatattgaccttcatattttcactgtatcttacaatcaagagttctacaccttcttttttacatctgacgagttaaaagattttatcaagggaaaacgcagcgataactcagacttataccatttttacttccaattcaaagatgggagatatatagaaaatcgagatcaggaatataacgtcactaaatactttgacaggtggacacttgtttcagacatgttagaataatttacgtggaggcatttagaggatattcctttgaatgtctctttctttttgtaataaaaaagacttcctaatcggaagccccaaaataaaaccacattattatttattttcgtcagggagtaattccatttgagacgctatcataaatttacctgaaccatttgaaggatctacaacaactggttttttagcgtttccatctttcccctttttgattattggtgcgtcgtctcttagtccatcatgttctattgatattatttctaaaaatcctttttctatattaacattccgccataagttgaagtatggaactagttcctcatagttaccgatacgatctgttaggtaagggtacattttccttgttggaactataagcacaccacctgttatatgtccatctaagagaaggacagccattttatttaatgcacgatgactggaagagacattccctgtttcccattcaacaacgaataatttatctgcaacatttatacaggcgtctaatgccccaggtttagatatttccatagagactgtttttcctacaagttcttcatcctttacaggtgcttcaaaatcaatagtaacaggataactttgtttaatcccgtctctatcagtatagacaattatttgttcatctctatttaccgacacaaccttcccatatataaggctagtgcttttcccgaaatttttaagtacctttattttagagatcttattttcagaagctgatgaaggaaactcagacttccacccataactttttaatttatcaataaaagggtttttaatgggttttaccccatttccacctttctttttaccatcttcaaaataagatttactatctgtattaaaatagaaaccgtcagtattttcaggcattcttaaacttttaatagcttctataatttgttttctaagaggttcaataatctcttttctttccttatcgtctacattgtttacaagaattgtttcatgaactattttcatttgtaaaaactatcccccttattcttacctttgtagcgtttagtcgaatgtagtaaaatcaaataagtccttaggttctacatctaaggctttagcgatcttttcgatattatctaaggaaacattccgagttcctcgttcaatatctgatatgtaggttctgtgaaggtcacattcaaaagctaatttttcttgtgacatattgtcttttgacaatcgtatttgacgaactttttgaccaaataacgatttaatattcttagtcatagtgcctcctctacaattgacgcttgtttaactggaatgatagaatggtgtagactataggtctacagactatgagttacatgaggtgtatagaattgcgtttttttactgtttttgacattgttaaaaataaagctgatcagttagggcatacggaagatgaaatgtatgcttttttaaagaaagaaaaattaaataagaaggatttactcgcttatcaagaaagtggaattattcctactgatgaaaaggtattgaatggaatacttaactaccttgatatgtctagggtggaattagaattgaagctgggaagaatacccgagggttttgaggacatattcctaaataacaccaaagaaatagctaaaattcttgaagaaagaaatagcgttcaggaagaagaacataaccctattccagcaactcagccttattattcttctgatttaggcaagctatacaatggagattgtttagaactctttaaacaagtttctagtgaaagcgtggataccgtttttgctgatccaccgttcaacttagataaagagtatgacgagggtgtaactgataaaatttcctttagtggatatttagactggtactataactggattgatgaatgtgtaagggtattaaagccaggtggttcattattcatttataatattcctaaatggaacacttacctgtctgaatacctaagcagaaaattgaactttagaaactggattactgttgatatgaagtttggacttccaattcagaacagactatatccagctaattacagccttttatattatgtaaaaggtgaaaagcctaagacatttaatgttcaaagaataccgttacaaacttgcccacattgtggtaaggaaataaaagattatggtggttataaaaacaagatgaatcctaatggtgtaactctctctgacgtttggtcagatatttaccctgttagacacagcagttcaaaaaacagaaagtttaatgaactgtctgtaaaactacttgatcgtataattagcatgagtacaaatgaaggtgacgttgttttagacccgtttggcggaagtggaacaacctttgctgttagtgaactattagggcgtaaatggataggctttgaattagggaattgtgaaattatcaaggacaggttagagaacaaagaaaaagatagaaagttatttgaaaaagtctatgaagaaaagaacaagctattccctgataaagtgaaggaattaagaaagaaaaatagtttatggactgatgatgattttaagacagatactgaaaagaaagaaacagaaaaggacactaagaaaagcaaagacaattttgatcagatttcattaagtttaaaatgataaagtaaaatggacttcttagcggaagtcctttttttattacaactatcaaaactcagcacaattgattgatctattccagcaacgcaagaatgaaggataggccacaattaaaagtgtcaatcaaaagggaagggctaataaggtgtgccctcacagccatagagtaagtatagactaacccgttacacctcactacagccgcatacaagcccatatagagggcataaagtatccacttgggcaaagggaatagtgaggacaaggacaaggcaggtggccatcacacgaggccacaggacaggaggcaagggaagggctaacgcgtaagtcaaagagaagggaaggaacggacgaacagcaaagaatgaatgaagaaacgaaaagaaaacgaatgaatgaaagcaaggaaggaacggctgaggccaccgctgtatatagatagatcagaaaggataaggacggaaggacgagaagcccacccatggggaggcacccctcccaaccccccctgtctggtgtttgcaaaatatatgcaccatttttgaaactgttgatggtaaattccgggtgtggctaagggcgattttaagccatttaacttttattagatgtgtgattatattactcgtttcgtctaagggtgttataataatcttaataaggtgggggttaactatgtctaatgaagaattactggaaattatagagaagtcattagaagaattaaaaagttatatggatttaaagtttaatgaaatgagatcagaatttcagaaaatcaatttgaaattagataagctgttagataagaggtgtgggggtgattaaggttttatcaaaatgaatagcagcgatccagtcaaaaaatttttggcgagtttttcgaaaactttttggcacattcaagcacaaaaaaagaaggacagaggtattaaatcctaagccctctatactctttattctgtttacttctacactcacagcaattataacgcctacctaaaaagccagtcgtttgagtttgaaaagaatattcaggcttaattgaatgacagctagtacattctatatgaatgagtccggcgacgtccttatatgccttgcgtcctctaagactgatggcgaataaacaaaggttcatttagatcaagccttcgtgtttaaagtaatcaatgactatcttaggattcacttgcattttttgggcaatctgttggggcgtgtaatcttcccatactagtttcttgaactggtctatagttatagaaggattcttctttttggatttacgtctacctccaacgtgttgaagcctttcgccgtttttgtcaccataaggcactccgcaaacatgacgctgatgatcttttcccaccatatgaaacggtttaccaaagaaaactaaaccgcatttttcacacttaaaacatactgcagcacgttgatttatataactgtttaaaggccttacagcaccatcattagctttatttaacttagcttcaaattctgatctattcatgtagttaaccaccttattagtattagttacgacaattagaaattgttttaggtataaaccccttgccctttgatttttaacctcttaaaaccatgatatataagggtttttaaagccctaattgtcgttatttagaccttttatgattgtattttctatgtgatttttttctagctgatttcctacaaatatcaccacagtaaacagccctattagagactgatttaaacgcctcgccacagcccttacagttcttattaactgtcattactcgtactgtttccttgccataataaacagactctagcgtcttatctaatggtaatacatactgttcaaaataattacagttaaaatcactagcaggtatctttttgcctcgatattcagtcccactaattaaaggacactcactccctaataatgcacattcaccgtttacataagttgcacatgattttttaacaagttcttgaatagttgtcattgtcctgatctccttagtaaataaaaagccaccagcgattattcgccagtgacttcttctttcatttgttttattagtcgttcttttacaccgctatctttaagacggtttaacatagccttgtttaattcctcgtcattgataggggatttttctttatagtccgtagataaggctaaaccatattgcatagctacaataggtgacaacccatttaaagcttctgtattaccgttctttaattctgccagtacgtcttgtttaactgtatttgataaattcatttattccacgtcctcgtttatagaattttggttatagtttaatttccctgtcataggacaacttagttctgtcaaagtcaaaagcacgtttaaagcttaaagcgttacttcgtctttcagggtcgtcccagctttcattcataagttccgaatcacttagaaagtcatcatatatcacagacattacttgactatcctgtttataaatttcattttcataatcggagatagcttgttttaactcgtcccttacatagtttacagcttcatttacattgaaatatgagttctttgcggataaatctttgctgtaagtacctctaataattggcatgtacttttcttttagtcccttgtattcatcctgtagttgcccctgtaatgaaagaagaatttcaacttcttcatcaatttctgtaagctgttttgatagataaatataatctgatggattatcccttgtgacctcacgatcaattaaagttgttgcgtgttgttcttgtagctgtgccaatctgttttcaagaaactcctcacgttcttttaatgccttcttttcagcttcatattcctttaacacctcatttgttgcattaaacatattatctaaattctcaatagctttatccactgccgaacggtcaatttttaacattataaaatccccctttgttgttttaaatccacaattcttttcactgatgacatttcaagttcactgatattcaatgaacgacacccttcaagaatctttgtttcataattgatacttaattcaatagcccctgactccaaacgtgctagaacagattgatctattttacaaacctgaccgaactgttcctgactcatgttcctacataagcgtaagtactttatcatgtgatgatttatcttagattgataaggtaagctgtttacattaaccccgatcattcttacacctcatttcttaaaatgaataatttattcagtcaaagccaaataaaaacaggcaaggcgtaagcctcacctagctatcaggaaatttccaatgacatttatccgtaacaggaataatacctgtctaatatacttgtttacgacagaccccctgaaatcaggttgattttaaaaatttttagaaatagatgtcctaaagctgtcctgaaatgcaagtacgtaagtgggtggttgtaagacaatccccaacattcatacattgcattaaggacggtgaacagcatgaaaaatactgtcattgaagttaataagcccgatcttataagatttgctaaagcaattatagaccttcataaaaaacaaactaatacgactagtggggaaaaatcctgctagtcttttcttttgtcttctatacatcatataaaaaacttagttcctacctttgtcgttgacgcaccaggcggaggaggtaaaatcgccctgcagccaaactatgtcctgtcacaaagtcctgacaaagtgatcttaagaaattttgaaggtgtgattacgtcatatccggaaccagagaattatatccccaatcaggcagacgcctattttgagtccgttttccctgaaaccgctgacaaaaaggagccgatcgggctgagtgccatttttgctgacaaagaagtttcgtttacacctgaaaatgtagacagaatcaaaaggagagaggcatacatcgcaaatccggagcatgaaacattaaaagaccgtcgtgaaaaaagagatcagctcaaagaaaagaaatttttggcgcagcagaaaaaacagaaagagactgaatgcggaggggattcttcatgaaaacatgcgaatggtgcggcgagcttgaagcggtgcccggcaggaacacggtgtactgggagctccctgatggaacgagggctatagaactgacagacacccctgccatggtatgttcttcctgcggtatgacctatcaagaggaaaacacggttaaggagattgaggatcagctgcttttaattcaaacaaaaaaactgcctgaaagcctgacatatcagcagctcatggagacagaaagaattttgaaacgcaactattttgacttctcctgagtcatgtttcagtattcttttgttgtaattttacacttgaactgtataatagaacaacaaaagacagacaccaggaggggaaacccatgaaatccttttatcactatttattgaaatacagacaccctaagccgaaggacagcatcagtgaatttgccaatcaggcgtatgaggatcacagctttccaaaaacatcaaccgattatcatgaaatcagttcatatttggagctgaatgctgattaccttcacacgatggcgacgtttgatgaagcttgggatcaatacgagtctgaagtgcacggcagataatagctgtttcatccgcagatcactgcggatttttttatgtcccccataccataattggatatttcctttggttttcatgcccatgcgaattggcttcacccggcatacgatagcgtatgagaaatgttgcggcgagggggagacaccatgaagcaaaataaaccgaaattccaagtaggggatatcgtagtcgtcattatgtatggaacagtcggcaccatcacaaaagtacaccaaattgataaacactatctttatgaagtcaatcataacgaagttttatactttgaatcatctattcagctttataaagattatgagggtgtcattgtcgacatggagaagcttgatattgagtatgaattccttattggggacgttgtttatgtaaaagattatggaaaagaactctttcgcattatcggccatagaacagaaatttggagatatttagaagatggctgggaagatatcatttatgagctgacccgtttaaaggatggagagtggcttgaaacggaggaagaggatctcacgctggtgcttagaaaatatgaaatggaccagtttgtgcatcagctgttgtttgtccattatgtcggagaaactggccatgagatcggcgaagatatcgcatcgtctgctcttcttcagtttgaaggcgatgatgaagatcaagatacccttcacatccttgctgtgtcaattgttgatgagcttctggatatttataatgactacaaaattctgtacgaaatgtttcatgatgaagaatataaagacatgatgatgtttgttttggaaagtttaaaagagcatttcagttagtttgtgaacatacggatcaagacatataaaaaatatggcagacagccccaaatcatcacacgcgtcattcctttgagcgttttttccattatgatatcaaatctttctccgtccagtgcttccatcattttagcaatcatagcgtcagcctcccatggctcgttttttattcaatatatgactgaaagaattgtttagaacaccgggtataattcagcctgttttttcataaaacataaaaaaggaggcggtacggagatgaaagaaatagatcttgtcattgatacggaagaaatcgctgaatttttttacagagagcttgcaagacggggctacataccgagtgaggatgagctgtttgaaatcgctgatatcacctttgattatttgatagaaaaatgtatgatagatgaagagctggatgaagatgagtgaggcttaaaaccggagttgtcagctccggttttattattcatgttctatgacttctgtgaaaattgaggtggttaaattgtacaagcccgttagtttgtttcttttctttctcattctagctgcggccattcatacaaatgctgttcaatctgcagatgaagcaataagcaaggcagctgttttgatccgtcagccatggcttaatgaagtcatgacggggatcacgcatcttggtgcttcttcttttctgctccctctaattgtcatcattggggcaggcctgtttttctacagaaaaacatgggacggcctgttgatgctcttagtattcggcacagatcggctgttaaacaaagtcttaaaagaatggatcgaaagagtgaggcctgattttgcaccgctggttcatgaatcatccttcagttttccgagcggccattccatgaatgctgcttgtgtctatcctgttattgcctactttttagtgaagcatctcccgtttttgtccaagcataaaaaaatggtatatatcatagccggtgtaattactgttttagtcggcataagcagagtgtatctgggggttcattttgtgacagatgtgttaggaggctttagcctcggcttgcttctgtttttcctagtaaaaggttttgacgaaaagattaagcggtttcgacaaaaatagagagaggaaaacacagcaaaaacgccaatatgttaaagaaataaaagggaggggatcttgatgatgttatccgtgtttaaaaagaagtcttgttcctatgacgtgacaatatttcagacaccccggtttggcgaaaaaaagggctacagagccgtctatcgaactgaactgaacgggagcgatcatcaagacgtgctgaaaagagcattctctttgtttaatgtattcgacactgttccgagtgattatgatgcaagatttatggccacaggggacgtgatcctgattgatgaaggcagaaaagggaaaacatattatcaactgcttcccgccggctggaggaaaatcaatcgtctgattgtacaaacgacataatgaaaagaaaactgcggaaacccgcagttttctgcagttttaaggcttgcgtttggcagcggaatattctttcccgtgtgcttcttcagctgcaatgatatctttttcaggtatatgattgttctttttttggccggtgatccggttgcgatgttttttacccatgtcccacccctccttcctgcggttaggttttcaaattaacaccccgattatccgtttttctgaggaagtgccaaacagatcctcgaacatttcttttttcgacatattcctttataatcaatgctgaagtttgtttcatcatgacattcgttgtaaaatggacgggctggatgataatttagatttacaggaggatatgagatgagtgtacatataggtgctgaaaaaggacaaattgcggatacagtgcttttgccgggagatcctctcagagcaaaatttattgcagaaacgtatcttgaaaatgtagaatgctacaatgaagtcagaggcatgtatggatttacgggtacatataaaggtaaaaaaatctcagtacaaggcacgggaatgggtgttccgtctatttcaatttatgtgaatgaattaattcaaagctacgatgtgcaaaatctaataagagtcggttcctgcggcgctattcgtaaagatgtcaaagtgcgagacgtcattttggcgatgacctcctcaactgattcacaaatgaacagagtcgcttttggaagcattgattttgcgccttgcgcagatttcgagcttttaaaaaatgcctatgatgccgcaaaggataaaggtgtgccggtgactgtaggaagcgtatttacagctgaccagttctacaacgacgattcgcaaattgaaaaacttgcaaaatacggtgtgcttggcgttgaaatggaaacaactgcattgtatacattagcagcgaagcacggaagaaaagccctgtcaattctcaccgtgagtgatcacgtattaacaggagaagaaacgacagcggaagagcgtcaaacgacatttcatgatatgatagaagtggctttacattccgtatcacaataaaatatatcaagaggcgtgctgggtgccggcagcctcttctttatgaatgcggaaacgattgataaaaggaaggtaatgtaatatgaaaaagtccggtaaatggttctcactggctgccgctctgagtgtaacggcaatagtcggagccggctgcagcatgtcgaacggtgatgctcaaaaggatacgaaaaccacagcagaaacaaagcaaacagaacaaaaaacagctgacagcaaaaaatcaaacactcaaaacagtgagttttcattggaaagccagtatttcaatgatattaaaaaagtcgatggtctggaaaccattcaaaatccagaaaatatactcgcgcttgtcaataaacaatatgcactgcccggaaactatgaacctagcgatcttgtcatacctgatgtagagttttcttttgaagaaaagattcaaaaacgttacatcagaaaagaagcggccgacgcattaaaaacaatgttcgatgctgccaaaaaggaaggctatgaactggcagctgtctcagggtaccgttcgtatgacagacagaaagtcatttttgacaatgaagtaagcctaaaaggggaaaagaaggcaaaggaagcggtcgcttacccgggtgaaagcgagcatcaaacaggccttgcgatggacatttcgagccggagcaatggctttgagctaaatgaagcgttcggaagcacggcagacgggaaatgggtgcaggacaatgcttataaatatggctttatcattcgctatccgaaaaataaagaagatatcacgaaatatgaatatgagccatggcatctgcgctatgtaggcaaaaaagccgcaaaggtcatccaagataatgatttaacgcttgaagagtactttgaaaaagtgaagaaaatttaaaatgaaaagcccgcttacactagataagcgggcttcattgtgtctggtgaatctagcatttgttctatgcttaccagaagaataaaccagcaagagcgacccctgtaattaaaccgagggaaataccgtaagccgctccgtatccccaataaccgccccaatatccgtaaccgaaacctcttggccctccgccggtcggagctataaaaactctgtctcttgttacacgggtaattctgccgacgtgaactctcccgcctctctctgtaattctgacgactttaccttgatggtttttgcaaagatgataatatctctccaatattgttcccctcctatcctgactttctatcagcatatgatagataggaaaaaaaggttggacgaaaacagggggcgatacgccgttttacttgtacgcgataaaaatacaatgacccatgtactcactatataactgcatgagctgataatgtgtttgaagcgtatcgtaatagatgggatcaatcgtttgcgataaatccatttctgtggttggttcaaattccatgtcttccggaagaagtgacatcgcttctgttttttgaaagccataggatcttaggagtttatgccattcgctttcttcatgtaagcaagtaaatccgtaaaaatccatcatttgcttcttttctgcagggggcattggtttttttaaagcagcttcgataccaatcagcatcccgctgggttttaaaactcttgaaatttcttgaagagaggatgtcaggcgtgaaaaactgaggaccgattctgacaggacgcaggaaaaggactcagaagaaaacgggagatgttccagctccgcctgatatgcagggatggcaagcccttcattcgcaaatctttttttcgctttctcaagcataataggatctttatcaacgactgttacaggatacagcaaatgtcctaaataagccgccgtttgccctgttccgcatccggcatcaagaatcggctgatccggagagggtgcagccttttgcaagaccgcttttgaaaaagccagcccgcctgggtgcgcccctgcgacaccgaataaggacagcatttctaaatatcggctcaatatcgaatcctcctttttccttatcatatgtcgtataaagacataggtttatgaaaagcaaaagaagggcgtttctctttcatttctgctccgagttgacgaataagaattcgtccatgataataatgtaagaagaaaaaggtggtgtttaattgaaacggcaattaaaactgttttttattgtgctgatcactgcagttgtcgcttcggcgcttactttatttattacgggcaattccagtatcctgggccaaaaatcagcaagcacaggagacagcaagttcgacaaattaaataaagcgtatgagcaaatcaaaagtgattattaccaaaaaacagatgatgacaaattagtagacggagcaattaaaggaatgattcaatcactggatgatccgtattctacatatatggatcaagagcaagcgaaatcattcgacgagacgatttcagcatcttttgaaggaatcggagcccaagtagaggagaaagacggagaaatccttattgtatccccaattaaaggttcacctgctgaaaaagccggtatcaaaccgagggaccaaatcattaaggtaaatggaaaaagcgtaaaaggcatgaatgtaaatgaagccgtcgctttaatccgaggcaaaaagggcacaaaggtgaagcttgaactgaacagagcgggagtggggaatatcgatctttccattaagcgcgataccattcctgtagagactgtctattcagagatgaaagacaacaacatcggagaaattcaaatcacttctttctctgaaacaacagctaaagagctgacagatgcgattgacagtttagagaaaaaaggcgccaaaggctatattttagacttgagaggcaacccgggcggcttaatggaacaggcgattacgatgagcaacctgttcattgataaagggaaaaacatcatgcaggttgaatacaaaaacggttcaaaagaagtcatgaaggccgaaaaagaacggaaagtgaccaagccgaccgtcgttttagtaaatgacggtacagcaagcgcagccgaaattatggccgctgcccttcatgaatcgtcaaacgtaccgttaatcggcgagacgacattcggaaaaggtacagtgcaaacggcaaaagaatatgatgatggctctactgtcaaactgacagttgccaaatggctgactgctgacggcgaatggattcacaaaaaaggcatcaagcctcaagtgaaagctgagctgcctgattacgcgaagctgccgtatttggacgcagataaaacgtacaaatcaggtgatacaggcacaaacgtcaaagtggctcagaaaatgctcaaagcacttggttacaaggtaaacgttaacagtacgtatgaccaggattttgtatctgtcgtcaaacagttccagaaaaaagaggagctgaaagaaacaggcatactgactggcgatacaacaacgaaattaatgatagaacttcaaaagaagctgtctgataatgatacgcaaatggaaaaggcaattgaaacactgaaaaaagaaatgtaaaaaaaccatacgcggctgccgcgtatggtttttttatgcacccttttgatttggattagcgtcttgttttttgccaaataaaccttcaatgacaggattggatcccacgtttttaacgaacagcggattcaggatcaccacagcgatcatgttggcggccaatccccagaatccttcataaatgccatgtgcggattgagtggtatacacaataaacgtaaccgcaaggccgactaataatccgataactgtcgcttctttcgtttgacgcttccagaatagactgacagcaatcgccgggaagatttgcaccatgccggatacacctaatagctggagtgtcactaaggcagtcgggaacagcattccaaacagcagcgcgagaccgatgacaacaaagaccattgaacgtgtgacgagggtcagcttgctttgcgccacattcggatgaatcaaatcccggtataggttgttggcgaataaattcgatgcgccgattgccataatggaacaaggtattaatgaagcaagagcgatagtggcatatgcaaagccttgtgccacgccgccgtaagatgtttgaatcaaatgcagcagcgcgagtcttggatttgtatcttccggcaggataagaaaggcgataaagccaagaaaaatgaccaaaattaacacaatattgtaaagcggcaaaaacatgctgttttttcttactgcatcagcgcttttcgccgtgaaaactcctgtagcggcatgtgcccacataaaaagtgccagagcggaaacaatagatgctgtgataaaccaaggaatgccttttggcccttctgacggtatcgtcaacatttgcggcgcttccttcactaacgtgtcaatcattggcgtccagccgttaaaatgaatgagagggagggacaccaccataaacagcataatgacccatactaaaatgtccttaatgatggctgtatatgtgggccctttaatcccgctgaaaaatgtgtaaagagcaacaagaataaatgaaatgatcacaacgaattttacgttaatatagccagtgccggcaacctgaagcgtgtcttgaatgccgctcagctgaaggcatatgtacggaataagcatgagtaccccaacgatggcaacgaggcttgccaaaagcttactgttaaaacgttcccgggcataatccgcgagtgttgttaatttatgaattttcgcaactttccaaagttttggcaagaagaagtaggcgataaagtaggccaacacagaataaggaatggcgaaaaatgcaacacttccgcctgtaaaagcagtactggtcaaccctaagaaagtataggccgtataaaggtcagcgcctactaaaaaccagacgagaagaccgccgaagcgtctgccgccgacagaccattcttccacagaagtgcgcgaggatttgtctcttccggcgagaaagccgatacagacaacggttaaaacaataatagaagtaatgagaagtgcagtcagattcccttgcattattcaagtcctccatcttttttttgcatctgataaatgccaaacgagcataacggcgtaacaataatccacagcagcagccaaaagtggaaaaacggcaggccgaacataatcggttctattcgattcacaagcggcaaaagcgcgagctgaacgaatggcaaaagaatgagaataacaataagtgcttttttaaccatttactttcctcctgaaacatgataatgctcactataatagcagttgttagaaaagatcacaagataattattagaaaaaaatgattttttcaattatttaaacaaaacacatggtttgcatccttttcaataaaggtttaaaataataaatatcttgaaatcgagataaataggagtgagaaaatgaaaacagaaggattgcaccatgtcattcgccagagatccgcaagaaaacttgcgattttatacagaagtgcttgggctcagacttgttaaaaaaacagtaaactttgatgatcccgggacgtatcatttttactttgggaatcaaaacggagatcccggtacaataatgaccttttttccgttccaaggaagcggacagggaacggtaggaaaaggccaagcgggccgggtgtacttttcagttccctcaggctccctgtctttttggaaggagcgtcttgagaaaagcgggctgagcctagaggaaaaaacgttgtttggtgaaaaaggtcttatttttgatgatacagaagaccttccgctggcgatcatggaggatgcgaaaagcggcaaaagcgagtggacgcctgacgggatcacaacaaatgaagcaattacgggaatgaaaggtgtgctgctatattcctacgacccgcaggcgaccatacaattgttaacggaaagctttggatacaccaaagtggctgaagaagaccagattgtcagactggcaacctcagcggccgtcggcggtgtcattgatgtccatttacaccctgaaaaaagaggagtcggaggatatggtacggtacaccatgtagcgtttcggactaagaaaaaggaacaggcgaaatggctgccgattattgctgaaaaccatctgccttcgtcagaaattctcgacagggaatactttacatcagtttatttcagggagaaaggcggtatcttatttgaaattgccacagatgaaccaggctttatgacagatgaaacgtttgctgagctagggacttccttaaaactgcctgaatggctggagaaacatagacaacaaattacagacattttacctgaactttaaaagggggaatttataatgaagcatatttatgaaaaaggaacatctgacaacgtacttttgctgttgcatggcacgggcggtaatgaacacgatctgctttcattggggcggtttatagaccctgatgcccatttgcttggtgtcagaggatcggtgcttgaaaatggaatgccgcgatttttcaaacgtctgagtgaaggagtttttgatgaaaaggatcttgtggtgcggacaagagaattgaaagattttatcgacgaggctgcagaaacgcaccagtttaatcgcggccgagtgattgcagtcggttattcaaacggcgcaaacattgcggcaagcctgctttttcattataaagatgtgttaaaaggggctattctgcatcatccaatggttccgattcggggtatcgagctgcctgatatggcggggctccctgtttttatcggtgccgggaaatacgatcctctttgcacgaaggaagaatcagaagagctttaccgctatttacgtgacagcggggcatcagcctccgtttactggcaggacgggggccatcagctgactcagcatgaagctgaacaggctcgtgaatggtacaaagaggcgattgtataaaaaaaccttagtccggatttcggactaaggtttttcatatccttacagccaagttgatacttttgaaagcggcagacggttgctttgatgcgcaggcttcactgctttgccgattgaaataagcataaccggaacatagcgcttactgatatcaaattgcttttggaactgctctttgttaaatccgccaattgcgcaagtgtcataaccttttgcttttgcggcaatcataagctgcatagcagctaaagaagcatttaagaaagcggaatcacgtgcgaattgctcgctttggtaagcaccgttgatttggccgagtaatgtttgtttgatttcatccgtaatatagccttggcttgctaattcagcataaacttcttcaccgttttcatttgcctttaaatcgcctaaaatggcaacaacagcagaagactcaacgatttgtttttgattatacgctacaggaagaagctccgcttttgattcatcgctgtggaatactgtaaaatgccaatgctgaaggttccaagcggaaggcgctttagcggcaaggtctaatagctcagtcagctcctccttagagatcggggcatttgtatcatattcctttacagatgcacgtgcttttaaaacatccagagtattcgtcatagtgtttcctccttcggataaacgtggtatgataatagaaaagttagaagcttactaaatgtaacttgaaagattattgtaatggatcattgaatacatgtcaatcaatagatgaagggatgaagacttgtgggaaatacgatgtgccctaaaatggaatccgcattctcattgctgggaaaacgatggaacggtctgatcatccatgtgctaatggatgggccgaaacggtttaaagagataacggaaacaataccgatgatcagccaaaaaatgttggcagagcgcttgaaggagcttgaacaaaacgagattgtcgaacggcaggttctccctgaaacgccggtcaaagtcatctacacgctgactgaaaaaggaacagcgcttcaagctgtatttcaagagatgcaggcatgggccgatcaattttgcgagcctggtgacacagtgtgtgaagaagagaaataaggaaagcggcgtctgaaaaagcgcacttgtttccatggtgagtcatgtaagtaaagttcacacccgtttacatgactttttatatttgtcagactgacatttccggattggcaaaattgtcatgtgcatatgaaggggatatataaaaataggaaatgatcaataagctataacatccaacctattgtaaatggggattatgatgtatcttattatgcaaatcagcaaaattttatattttcggccaaagtcagcttccaatttgcatttaaaccggatataaaagaagatccaggtttttcgtattgctggatgcttctatactgatgacttccgcatttatgaaaaaaagagagagcttctttggagctctctctttttttatggggagacgaaatcttatagttttccattcaaaaattgcgcctcaccgagaccgaaactccagtctgcgtcaccattctcagtaatagataccatgaggtcttcaggggaaattccgcatttttcttctagcctttcagcaagcagagcatacaatttttccttttggctttcggttcttgctttgcttgtcatactaatgatgaccagatccttggttctctgaaaacctaatcccgtatcttggattataagctcgtttgcgggatgctgatggacaatttgataacggtctctttccggaacgccaaacgcttcaaccatcgcttggtgagcagtatctaataacaattgcagcgatttttcgtcacggccttcaattacatcaaaacgcaataatggcatgtgtactcctcctcttgtgaagttgttatccgtctgttctcatattgtctcatttgcttccagacaatggagagatataatgattggcagtcaactttaaaaaacataacatataaccaaaagttaatcaacatataactaataaatcattgggttaggcggtaggtaatcgagacaagctcataaaaacgattgacagtcattgattaggagattagtatgaacatattagttgatcaaaagataacaatcatataaccaagacgtttttagttattaatgaaagcgctttctgttcatctaggcatgaaaagcgccaaaacattgtcgcgagaatcatataaaacacttttggaggggtaccatgccgattttaattgtagctgtcggagtgctgattctgttatttctcattattaaagtaaaattaaatacctttgtctcactgattgtcgtttcatttttagtagccatcggacttggaatggatatcaataaaattgttctttcaattgaggctggaattggcgggcagctggggcatttagctttagtgtttggacttggcgcgatgctcgggaggcttgtctcagatgctgggggcggctaccggattgccattacgctgattgacaaattcgggaggaaacgaatacaggcggcggttgtggttgcctcttttatcatcggtattgcgctgttttttgaagtcggtcttgttctgttgataccgattgtatacgcgattgctaaagaattaaaaatgccttttctgtatctgggaatcccgatggccgccgccttaaatgttactcacggatttttgcccccgcatcctgctccaactgctatctcagttgcatacggtgcccatattggccaggtgctgcttttgggaatcatcatcgctgttccgacaactgtgattgccgggcctttatttaataaatttgcgatgaaacggtttcctggtgcgtatcaaaagcatggaaacttatcggggttaggaccgaggaaagaatttcagctggatgaaacaccgggctttgcgatcagtgctgtcacgtctttattcccggttatctttatggcaatggcaacagttttttctttattattgagtgaacattcaaaaggaaaagacattatagaatttatcggcactccgggaacggcaatgctcatttcgctgttgcttgcactctatacgatgggatatgcccgtaaaatatctatgcaggaaatcagcagatctatctcagaatcaatttcccaaattgcgatgatgctgctcatcataggagggggaggagcgtttaaacaggtgctgattgacggcggggtcggcgattatgtcgctgattttttccgtcaaacaaacatgtcgccgctattcgttgcatggaccatcgccgcggttctgcgtctgtgtctaggctctgctaccgtggctgcgcttaccacagcgggaatggcagctccgcttatggaggctggcagtgtaaaccccgcgttaatggtgcttgcaacaggagccggcagtgtcattgcgtgtcatgtaaatgatgcaggattttggatggtaaaggaatttttcggcttgagcatgaaagaaacatttcaaacctggacgttgcttacaacagttctttcggttacaggactcggctgtgtgttattggcagggcttgtgatgtaacaatcatagacagtccgtagcccaatcgtttttcttccttgctgaatactttacgtataggcagacataaaggaggaaaaaatcatgtaccctcatcattcgtatttacgcggaatcccaggtccagccggatatccggcgcgtagtccttttttgtttggcgctcctctagtcggcggtttattaggcggttttctcgggagtgcgctgtttaactattctcgtccctatgcctatcctcctggcccttatggatatggaggcggaccgtacggttttggtgccggcgtgccatacgggggatatcccggcttctattaataaaaacggcctgcatcgattgcaggccgttttttatcggatgatttctacctcggacatattgtagtcttgctgcttttgaaacatgacttccagaaggccatccttatagacggcttttgttcctttgcgtttgactaaacaaggaaggtttacttttttcggatgatctgctcttgggaagttttccaaccataattcgtgagatgtgtgtttgattctcacttgttccagccattcttcgctgattggcacctttacaaacacatggtctgcagtttcgaatatatcaatatcaggtttgacatcaggttttgcatcaggtttggcgggctgttctttttgggggagaggatcgcggaaaggaaattgagccgcataatcactgccgaacacactttccatcacacgattgacatacgtttcaacttctttcggatcagctttttttaatgcttctttagaaaattgattgtggaaaggaaagtacttgttccactcaaacattgtcttcacatcctttcttcacggacaaaatagtatatgcccgccagatctttcacgtgatataatataagatgctctaaagaaaggcagggatataaatgcaatattcagaaacaaaaaaaggcgttatttacacagccgtttcctttatcatgtggggcctgtttccactctattggaagcttctcgaacagctgccggctcttgatattttggctcatcgtattatatggtcttttgtttttatgtgtatcgtactttttttcttgcggcaatggaaaataggatggcaggagctgcgctctctgaaaaagaacggagggatcctctctttatttcttgcttctatcctgatttcgatcaactggtttgtatacatatgggctgtcaaccatggctttttgcttgaggctagtcttggctattacattaatccgcttgtatcagtgctccttgggattttatttttaaaggaaaagctgaatcgcctgcaattagtggccgtttcgattgcggcagccggtgtcatcatctcggcgttccaatacggctccattccttatgttgcgcttctgcttgcattcagctttgggctgtacgggttaagcaaaaaaagaacaagcctgccgagcgccatcggattaacgctggaaacattcatgattatgcccattgcattggggtatttgctgttcagtggacatgatcagccagcgggtgcagaaagcggagggacgtggctgcttctctttttggccggtgtgtttacggctttgccgctcttattgtttgcggaaggagcgaaacggctaccactgtatcaagtcggtatcttacaatatattgcgccgaccattaccctgctgatcgggctgtttgtttaccatgagccattttcaagctcgaaggcttttacattcagctgtatatgggctgcgctgctcttgtttacgttttcacaagtgaagtggaaacgggcgtcaaaaagccattgaggcctttggcttttcagctgatgcatatattatgtataatcatttcatgtatgtaagacataaaggagcaagacgatggacaatgataaagagatagtgaaagcctatgcttcactttggaataaccgatctctcgcacatgatgacgcagaagaggtagcagaggcgattgatcttgagctcttggataaacgaacacatccaagactccgaaaaccgatgctggaaaaatattttgccgcgattcagcgcattgtgaattcacagctcgaaccggctgtgaaatatcagctggtcaaattacatacagaacgtgcagagtatttaaaagaagaaagaggggagcaatcatgaaagcgatcataaaagaagatgtgcaagcatctttagaacgatatgcggaccgccctgtatatatccatttagaaaccaccacaggttcttattcagcgcacttaaatgaaaagaacatgacggttgttgcgtatatccgcaatgcaaaagtcacttatcatcaggcaaaaatcaaaggcaacggaccttaccgcgttggcttgaaaacagaagaaggctggatttatgctgaaggcttgactgaatacacggtagatgaagaaaaccgtttattaatggcgggacatctgccgggcggtaaactggctatttctctgcaaatcagcgaaaaaccgttcacagtttaaagaaaagggtgaataataatgaaagaacatgtactagtaatcctgcctcaccctgatgatgaatcatatggagtggcaggcctcattgccttaaacagaaaaaaagacattcccgttacgtatgcctgcgccactttaggtgaaatgggcagaaatatgggcgatccatttttcgcgaatcgtgaaacgttgccgctattaagaaaacaagagctcatcaatgcctgcaaagaaatggatatcaatgaccttcgtatgcttggactccgtgacaaaacgctcgaatttgaagacgatgagtatctagctgatatcatggaagagatcatagatgatgtaaaaccaagtttaattgtcacattttatcccggacacggtgtgcaccctgaccatgatgcatgcggggaagcggttatccgtgcattgtaccgcaaaaagaaagaagaccgtccgcgtacaatctgcatggccattacccgcaacagagaagaggttctcggcgaagctgatgtcgtgcttgatatcaaagaagtagctgatattaaaatgaatgcgttaagagctcaccgcacacaaacagaaggcatgctcagagagcttgaagagaaattgaaaaataatgaacctgttatggcaacatggtttgaagaagaaatatattggacgtatcgatggaatgattaatcaaaaaggtataaggccttaagccttataccttttttaattttaagtccgatgcaattgctgaagcgagagtggatctcaaggaaataccttcgaaagacaaacctagctgaaccgctgtttgcgcgatttccggacggattccagacaaagttgaagaaacaccgattaaacgaagcgcctcaatcagactgaacagctgatgggcaaccatcgtatcaatcacagctactcctgacaaatcaatatacagttgtgtcaccttttttttcgcacattgatgcagtgtgttttccataatcagcttggcgcggactgtatcaatatctccgattaaaggcagcagtccgacgctgtgaaacagcacgatgaccggagcgctcaattcagtaatcatatctttttgggcctgaagctgaaggcttgtgtttttgtacatttcttctataaaaatatgaatcacaagatcaaacgcttttataagggcgtgatacaggtcttcggcttcttcgcttttcacagtatcctgattgagatggacaaattctttcacataagaaacatataaatctctcactctgacaaactcccgaataatatagtggataggagtttttaaatgctcttgatcctgtgtgacctcaaaggcccattctttcagtataggcaagtatatgtcctcatcatctataaaaatacggtttattttatagttaaaggcaagattctggctctttaaattgtgaatgacaacagggtctgttgaggcataaatggaattgggatcagtctcctcgattgtttcataccatgttgaactgatggtttccgcatgctgggaaagatactcgaataattttttgttttttgccatgattgatcacctcttttaaatgtgttgtttttgcgaataacgtttttgcagttttgccagcctgaaaaacagcccaactgctccggcggcgagtcccgctattaatccaatccaatagccgaatgcaccgaggcttgtaaacgtaccgaccatataaccgaccggaaggccaatgacccagtaagagacaaaagcggccgcaagcgtatagttcacatctttgtaccctctgagtgctccctggatcggtgcggcaacagcatcggaaagctgaaaaaatagcgcataaattaaaaagtgctgtgtcagccggagcacatcggggtcagaagtgtacatgcccgcaatttgctctctgaataaaaggatacaggcagcagtgaacaaagaaaagccgatcgccatcatgatgccgattaagctatatgagcgtgcatccttaaaacgggctgcacccgcttcaaacccgacaacaattgttagagccatggacacgctgagcggcagcatatataaaagagacgcaaaattcatggctgcctggtgggacgcgatggtcactgtatgaaaattgctcattagaagcgtgacagctgcgaaaatgctcgtttcaaaaaacacggcgaacccaataggcagcccgattttgagcaaatttttgcatgctttccaagagaacttatacatggtaaggaaaatcccgtattcagaaaacggtgcgtttttatgaataatgaaaaaactgatgatgcagatacaccaataagttaaagcggatgccagccccgcgccgacacccccaagtgccggcattccgaacttcccgaagataaatacataattcaatacaaaattgatcggaagagaactgagtgtaatcatcatggtgactctcgtttttcctaatgagtcgatgaatgatctcaacacggtgtaaacaaataaagggaaaattcccagtgataaaaagcctaaaaagtgtttagcaatctgatgcacgtgaatatcaaggttcaatcggccaagaataaggtcaactgcagcatatccaatcaataaaacggcgatgctaagtagcgcggccacgtatacagcctgtaaaacagtaaaggggatcttctgttttttctctgcgcctaatagctgagcgacaatcggggtgaccgccattaatatacctgcaagtcctgtgtaaacaggggtccaaaggcttgagccaatcgcgacacccgctaaatcagcggggctgactttccctgacatcaccgtatctagaaaagtcataagagaaagccccgcctgggtaatgaatatcggtattaaaatgtgcaagagctgtttgattttttcccgggcattttgagtttctttcatacattgatctccgtttctttttcataacgagagaaattataacattttatgtataaaaagcaatgaacgccgggcctattctttttttgtcggtttcgtttttctaaacatttgggcataaataaaagaaagcgaaatcacgcctaaaaaggtgcaaatatactgaatgattctttcgatttccattctttacatccctcctttaccaatagaatgtgcatcaataagataagcattcgtgaaaagttggaaatttgaacaggagatgaagattatgcgctatgagcagatatcagaaaatgcgttcaaggggaaaatacaggtgtacctagagcaaatattaggtgatgcatctctaatcttgaaaacgcttcacgaaaaagaccagtgtctcctttgtgaattagatgaattagggcacatttttcaggacatgcaggggattgcatcctccttttatttgcaatcatacattgaggaatttacgccggcatttattgagctggccaaggcgattaaagccttatcggaacataagcatggagctttaattgtgattgaaagagcggacccggttgaacattttattcaaaaaggcacctccctacacgccgagatcagctcttcattaattgaaagcatctttttccccggaaaccctcttcatgacggcgctttgttagtgagggaaaacaaactcgtgtcagcagccaatgtgctcccgctgacgacgaaggaagtggatatccatttgggaacccggcaccgggcggctctcggtatgtcgggctatacggatgcactggtgctcgtggtttcagaggaaacagggaagatgtcgtttgccaaagacggtgtattatatccgttaatttcaccaagaacgtaaaaataataaaaagggcctgattaagaatcctatcatgagacaaaatgactgaattcgcatctttattaaagcattcgcttcaagctgaatgctttttgtcttgaagacagggaatataaactggtagaaaagttatatatgatgaatattaattaagtgaaatactttacctgtttatgcatttatagtaccgtataaaatattacataaattctcaaaggaagggtgctgccgcatggctaatgtattaatgatcggtttccccggtgaagggcatattaatccctctatcggtgtgatgaaggagctgaaatcccggggagaaaacattacgtactacgcagtgaaggaatataaagaaaaaatcacagctcttgatatagagtttcgtgagtatcatgatttcagaggagattacttcgggaaaaacgcaaccggcgatgaagaaagagatttcacagaaatgctctgcgcttttttgaaagcctgtaaggatatcgcgactcatatttatgaggaagtcaaacatgaatcgtatgattatgtcatatatgatcaccatcttctcgcgggtaaagtcattgccaacatgctgaagctgccaagattttcattgtgtacaacctttgcgatgaatgaggaatttgcgaaggaaatgatgggagcgtacatgaaaggatcacttgaagattcgcctcattatgaatcataccagcagcttgcagaaactttaaatgctgattttcaagcagagatcaagaagccatttgatgtttttttagctgatggtgacttgacaattgtctttacatcaagggaatttcagccactggctgagcaatttggcgagcgatatgtatttgtcggtccttccattacagaaagagccggaaacaatgatttcccatttgatcagattgacaatgaaaacgtgctgtttatttcaatgggaaccatttttaataatcaaaagcagttttttaatcaatgccttgaagtgtgtaaggactttgacggtaaagttgtgctttccatcggcaagcatattaaaacaagtgagttaaacgacattccggagaatttcattgtacgcccgtatgtccctcagcttgagatcttgaaaagagccagcttatttgtgacccacggcggaatgaacagcacaagtgaaggtttgtattttgaaaccccgctcgttgtcattccgatgggaggcgaccaatttgttgtcgcagatcaggtagaaaaagtcggcgcaggaaaagtaattaaaaaggaagaattgtctgaaagcctactgaaagagacgatacaagatgtaatgaataatcgttcgtatgctgaaaaggcaaaagaaattggacaatcactgaaagcggcaggcggctctaaaaaagcagccgatagcattcttgaagctgtaaaacaaaaaactcaatcagcaaacgcatagtgtaaaagcctgttcttatcgaaagaacaggctttttgccatttcataagaatgcagaggaagggatttgatacgccgatagagaattgattagaaaaatagacaagaaaggaggagaaactgcttcgttcatcaatagaaaaccatcattttaccctcacttaaatagttccttagactttcgaaaaacatatcgtgcttatgtaaaatgttagatgtttatttgaaggtttaaaggtcgaacgatgctgaaaatgctgcgccaaatgtttgaaaagggtttaacttgctgaaaaattgacgataaaacagttgtgtgccatttttggaaacaaaatactagctgtttttacaaaaaaaacagtttaggaggttgaatgaatgaaaaagaagattgtagccggcttggctgtttctgcagttgttgggtcgtcgatggccgcagcacccgcggaagcaaaaacgataaaagtaaaaagcggtgactctctttggaaactttcccgccagtatgatacgacaatatcagctctgaaatccgaaaacaaattgaaatcaacggtgctttatgtcggacaaagtcttaaggttcctgaaagcagcaaaaaaagcacgacatccccatctaattcaagcaaaacgtcaacatacacagttgcatatggtgattccctatggatgattgctaaaaatcataaaatgagtgtttctgagcttaaaagcttaaacagcctgagcagtgacctgattcgtccggggcaaaagcttaagatcaaagggacaagcagttcaagcggatcaaatggatcaaagaaaaacagcggttccaattcttcaggttcttcaaaaagtacatatacggtcaagcttggtgactcactgtggaaaatcgcaaacagcttaaatatgactgtagccgaattaaaaaccttaaatggcttaacatcagatacactttatcctaaacaggtgctcaaaataaaaggaagcagttcgcctaagaacggaaacagcggttccaaaaagccgtcaaactccaatccctcaaaaacaacgacgtacaaggtaaaagcaggcgattcgctgtggaaaattgcaaatcggctcggagtcactgtccaaagcatccgtgataaaaacaatttatcatcggatgtgctgcaaatcgggcaggttctgactatttctggaacatcaaaatctaatccttcacatccgacaaagccaacaaagccaaaagataactcagggtcaaacattcaaataggctcgaagattgacagaatgatcacggaagcgaaaaaatatgtcggagtgccttaccgatggggcggaaacacgcctgccggttttgattgcagcggcttcatttattacctcattaataatgtatcatctatatcaagattgagtacggcaggatattggaatgtcatgcagaaagtcagccagccgtcagtaggagactttgtcttctttaccacatataaatccggcccgtctcatatggggatttatctaggcggcggtgattttattcatgcaagctcatcgggcgtcgacatttccaatctcagcaattcgtattggaaacagcggtacttgggcgcaagaagttatttttaaaaatgagtatgacaaaaagccttttataggcttttttgtttataccagacaatgattgaccacactgttagaaaaaacaagggggagacagtatgcaccgtctcttgctgttgatgatgctgacggcactgggagttgccggatgcggacaaaaaaaacctccagaccctcctaaccgggtgccggaaaaaaaagtggttgaaacgtcagcgtttggtcatcatgtccagctggtcaatcgtgaagggaaagcagtcggttttatagagatcaaagaatcagatgatgaaggcctcgatattcatatttccgcaaacagcctgcgtccaggtgcttctctcggttttcatatttatgagaaaggttcttgtgtcaggccggattttgaaacagcgggcggtccctttaatccactgaacaaagaacacggcttcaataatccgatggggcatcatgccggagatctgccgaaccttgaagtcggtgctgatggaaaggtagatgtcataatgaatgcgcctgacacttcactgaaaaaaggaagtaaactaaatattctcgacgaggacggaagtgcatttattattcatgaacaagcggacgattatctgacaaacccaagcggcaattccggtgcgcgtattgtctgcggagcccttttgggaaataacgagaagcagtaatatcatccaagcccttttgtattgagcatacaggggcttttttagtatactcgttaatggaatatgaataggaaagggaatctgtctatgacaactcaactacagcacttaacattgccggaagatatacaacaaaagcttttatcatataaagagcagcctatttccccggagtttcaatcgcttataggaacatcaggctatgaggcggaggatgaagccattttatttgacgccattattgcattagccatggggaaaaatgtcctgctgaaagggcctacaggttcaggaaaaacaaagttggcagaaacattgtccagctattttaataaaccgatgcacagcgtcaactgttcagtcgacttggacgctgaggcattggtcggttataaaacgattgaaaatcaatctggccaggcgacaatcgagtttgtttcaggacctgttacaaaggcaatgaaggaaggccattttctttatatagatgaaatcaatatggcgaagccggaaacactgcctattttaaacggtgtattagattacagaaaaatgatgacaaatccgtttacaggcgaggtcatacgggctaaaagcggtttcggagtcattgcagccatcaatgaaggctatgtcggaactgttcctctgaatgaagcgttgaaaaaccgttttgtcatcattgatgtgccttatattaaaggcgagctgctgaaacaagtgctcatgtctcagtcagccctgaaagacgagaaattgattgacagatttatcacgctttcctctgacttgatcgttcaggccaataacggacaggtgtctgaagaagcggcgtccatcagagctttaatcgatacatgtgatttagctgcttatattccgccgcgtcgtgccattgagcgaggaattgtagaaaagcttgatgatgatcgggaaaaagcggccgtccgaaatattgcagaaactctgtttgaatgagggggctgcgatgaaatttatcaaatttaacgacagcacgattgattcatttttatttatgatgctgactgatttggccaaaacactcaccaagagtgaagcggtagaagtggagtatggcgttcagtcctattacaatccatttgaaaagaaaatctatatgagccacttttggaaagacagggcagctgaggacatggaagcgggtctgaaaagcgacgtctacctgcgttcagtcggaacaagatatagctcgctgcatgagtttgcgaactttttgaatgatacccatcgtcatctcacctttaaaagttttgccaagcagctctttatgctgcttgaagacattaggatcgaagaatgcatcaaacgtgagcgtccgggtacgaaacatgtatttgcgaagcgaaaagacatgtacagaaaacatttctcaacccagctgaccttaaatttggaacgaagcatttttaccgatgcgctcttttgcgcgatctatgtcaagctcacagcggaatcgccgctcgagacccttccatccatgcgtgaagatatcgatctgatgcgcccgtttattgagcagcagctcttgcgtgtgtatgaagcagattcgacacggcaggttctgaaaattgttgaggacctcatggacggacttgaagaggtactcgataaagacatgttgaacacctacttctttttgcctgagcttgattacgcaaaagctgcagaacagccgttatttgaagaagagaaaaaagcgccgaagctgagtgatgacatcacgcttccaaaacaatcagacggtgatgaggatatccatgaagaagaaatgccgacatggcaccgggaaacagaagcaccgtctaaaagcttccttcaatttgatattgaacacggcgcaaaatcagatttaggaaaagatgcttcaagggaaggcgacgatggagatcaggcccttggctctgttcaaggatcagccagacaaacgaaacggaaagactattccaagctggaagcgctggagtcccaaaaagaccagccgaacggagcgggtatggctgacggcaaagaaaataaatatgcatttccaatttataaagaaccgcagccggcaaccagtgaagaagagctttcttataaacagcaggcaaaaacgattgaatcgtatcaaaagcgtttgaaacaaatgattcaaaaaacgctggagcataaaaaaacattgccgagaacagaccttcatgccgggagactgaacaataagcttcttcgttacttcactgagcgaaatccgcgcctgttctacaaaaagcaagaaccatcttcagaaatcgacgcagtttttacattgttggtcgattgttccgccagcatgttcgacaaaatggaagaaacaaaacgaggaatcgtgctgtttcacgaagcgttgaaatcggtagcggttccgcatcagattgtcggtttttgggaggacacaaatgatgcaaccgaaacaagccagccaaactatttcaatacggttattcccttccaatcatcattaagacaagattctggaccggccattatgcagcttgagccagaagaagataaccgtgacgggtacgcaattaggcagatgacgaaaaaaatgctgcatcgcagcgaggcgcaaaagttcttaattgttttctcagatggagagccggccgcatttggctacgaacaaaatgggatcgttgatacaagtgaggcggttatcgaagcccgaaaaagaggaatagaagtgataaatgtttttctctccaactcagaaatagaagaatcgcaaatgaagacgatccaggatatgtacgggaaattcagtatatttgtcccggatgttgatcagctaccggatgttttgtatccgctgctgaaaaaactgcttcataaaagcataggatagcccttaatcctatgctttttggcgtttgttttttcgaatgattaaattttttgttttttataaaggttttttactattttgtgaacaatcaaggtagaatcaaattgcaaacagtggtaaaatatcgttggaagcgtttttattacataattttggacacagcgttcgaaagttatttcaagatagtgaatcaatcacttgattatttaagttgggggtaatattcaaatgtttcaaaatagtatgaaacaacgaatgaattgggaagatttttacggtccgaacctcggctatgcgctggagctttacgatcagtatacccaggatccgaacagcattgacccggatttgaaggaaatgttcgacgagctcggtgctccgccaagcgatataaaagaggcctcgggaacaaaagaaaagggacgtgttacagccgatctgattcaaaagatcgcatccgcagtcagacttgcagaagatatccgaacctatggccatttgaacgcttccgtcaatccgctcagaaaggatgagaaaaagagcgaactttttccattatccgattacgggctaacagaagaggaaataaaagcaatacctgcgtctgtcatctgcaaagacgctcctaaaaacattacgaacggtttagaagccattcagtatttacgaaatacgtataaaagaaccatctcttttgaatttgaccatgtgcatgacttcaaagagcgcgagtggctgacaagaaagattgaatctggcgagctgttccagaagaactcagctgaaaagctgtcagctgtgctggaaagattgacagaagtagagggctttgagcagtttttgcaccgcacattcgtcgggcagaagcgcttttccattgagggtctggacgctcttgttccagtgcttgatgacattattgcacaatctgtcaaatcaggcacgacaagcgtcaacatcgggatggcgcacaggggacgcctgaatgtcttggcacatgtgctcggcaaaccgtatgaaatcatcttctctgaattccagcatgcgccgaataaagatcttgtcccgtctgagggatcaattggaatcagctacggatggacaggggatgtcaaataccatttgggggcgaatcgggagcttcaagacgctgaaacaaaatcagcgcgcattacgttagcgaacaatccgagccacttggaatttatcaatccgattgttgaaggcagcacaagagcagcacaggaaacgcgaacacaaagcggatacccggtacaagatgaaacaaaatcgctggccattttaatccatggagatgctgcattccctggggaaggaattgtagctgaaacattgaatttaagctctttaaaagggtatcaagtaggcggtgcgattcatattatcgccaataacatgatcggattcacaacagaaagcgctgaatccagatcgacaaaatatgccagcgacctggccaagggttatgaaattccgattgttcacgtgaatgcggacgatcctgaagcttgtctctcagctgttaagtttgcggtcgaataccgaaaaacattcaacaaggattttctgattgatttgatcgggtacagacgctatggacacaacgaaatggatgaaccgtcaaccactcagccaatgctgtatgatgctgtcagaaagcatccgaccgtcaaacaaattttcgctgaaaagctggtaaaagaaggcgtgcttaccgaggaagtcgttcaaaacatcgaaaaatcggtaacgaagcgcattgaggatgcatatcagaaagttccgtctaaaaaggaacacacttcctgtgaaattgaacttccagagcctgtatcaaacggtttcccagatgtggacacttcgattaattttgatgtgctccgcaagctgaatggcgaattgatcaactggccggagtcatttaatgttttcggcaagctaaagcgcattttagaaagacgcgccaaggcgttcgatgatgacagaaaagtggaatggtctttggcagaatcactcgcgtttgcttcaattttgaaagacggaacaccgattcgtttaacaggacaggattccgagcgcggaacgttcgcccaaagaaaccttgtgcttcatgacagtgagacgggcaaagaatttgtgccgcttcatcacttatctgactgcagcacatcatttgctgttcataacagcccgctgtctgaaggatcggttctcggttttgaatacggctataacgtgcattcaccggaaacgcttgttttgtgggaagcacagtacggagattttgccaacgctgctcaagtgtattttgaccaatttatttctgccggacgcgcgaaatggggccaaaaatccggattagtcatgctgctcccgcacggttacgagggacaggggcctgagcactcaagcggaagaatcgagcgattcctgcagcttgcagcggaaaacaactggacggttgccaacctgacaagcgcggcacagtatttccatattttaagaagacaggctaaaatgctgcttcgtgaagaaatcagaccgctcgtcattatgacgccgaagagccttcttcgcaacccaaatacggtgtcggaagtgcaggagctcagcgaaagccgcttccagcctgtttatgaacagtcgggactttctcatgactatgaaaaagtaaccagacttgtattatccagcggtaaagtgtctatagacattagcgatcattttaataagttagaagacggtaaagagtggcttcacattgcgagaatcgaacagctgtatccattcccggcaaaaggagtcaaagaattatttgcaaaacttccgaacctgaaagaaatcgtttgggtgcaggaagagccgcagaacatgggggcttggggttatatcagcccgtatttgacagagattgcaccagagggagtaagcgttcaatatattggacgaagaagacgatccagccctgcagagggagatccgacagttcataaaaaagaacaggaacgtattgtatctgatagcttgactcgcaaaaactaagggggaaatgaaaaaatggcggaaattaaggtacctgaattagcagaatcaatctcagaaggaacaatagcccaatggttaaagcagcctggtgactatgtagaacagggtgaatatctgcttgaactagaaacggataaagtgaatgttgaattgacagcagaagaatcgggtgtacttcaagaggtattgaaagattcgggtgataccgtccaggtcggagaaattatcggtacgatttcagaaggcgcgggtgaaagttctgcccctgctcctacagagaaagcagaaagcaaggaaagcgtaaaagaagagaaacaggctgaaccagctgcacaagaggtgagcgaggaagcacaatctgaagcaaaatcaagaacaattgcttctccgtcggcccgtaagctggcgagagaaaaaggaattgacctgtctcaagttccaactggagatccgcttggaagagtgcgcaagcaggatgtcgaagcgtacgaaaaaccggcatcaaaaccggctcctcagcaaaagcagcagcctcaggctcaaaaagcacagcaaagctttgacaaacctgttgaagtgcaaaaaatgtcacgccgcagacaaacgattgcaaaacgccttgtagaggtacagcaaacatcagcgatgctgaccacatttaatgaagtggacatgacggctgtcatgaatctcagaaaacgccgcaaagatcaattctttgagcaaaatgaagtgaagctcggctttatgtctttcttcacgaaagcggtcgtggctgcattgaaaaaatatccgttgttgaatgcagaaattcaaggcgatgagttgatcgttaaaaaattctacgatatcggaatcgctgttgctgctgatgaaggccttgtcgttccggttgtgcgggatgcggatcgcctgacatttgcaggaatcgaaaaagagatcggcgagcttgcgaaaaaagcaagaaacaataaattaacccttagcgagcttcagggaggctccttcacgattacaaacggagggactttcggttcattgatgtcaactccaattttaaacagcccgcaagtaggtatactgggcatgcataagattcagctgcgccctgtagctattgatgaagagcgtttcgaaaaccgtccgatgatgtatatcgctttatcttatgatcaccgaattgtagacggtaaagaagcggttggtttcctcgtgacaatcaaaaatttactggaagatcctgaacagcttttattagaaggataataaaaaagggtacatcacgataaagtgatgtaccttttttgatgcatatttaaagtgatagattgctgcttttggatccagcttgtttctttttcacttttttcgaccaatatgttgcaagcatagaacctgaaaggttatgccacacactgaatattgcgcttggtacggcagacaacggtgagaaatgagccgtggcaagtgcggccccgagcccggagttttgcatgccgacttcgattgcgatcgctttttgagacgggtaatccatttttaaaagctttgcacaaagaaacccaagtaaataaccgataccgttatgcaggataacaactgaaaaaatgagcaaccccgattgaagcagattttcccgattgccgctgacgacagctgagacaatcgcaacgatgccaatgacagaaacaagcggaagggcatgtacggcttttgccacttgttttctgaaaaacattttgacaatcagacctgcaatgatcggaaataaaaccgcctgtaagattgagataaacaaagaccccggcgagacaggaagccattctttggcaaacagcataatcaacaacggtgttacaacaggtgccaataaggtagaaatggtcgtaaccgcaacagaaagggcagtatttccttttgctaagaatgtcataacattagatgcagttcccccgggacagcagccgacaagaataacaccaactgcgatttcagctggaagatgaagcccaaatgcgaggccgaaagcaacgagcggcatgatcgtatactgagctattactccaataataacttgccaaggctttctgaccagctctttgaaatcatcggcttgcagtgtaaggcccatcccaaacatgataatgccgagaaaaatcgtaatataagaactgatccacgtaaataaagatgggaaagaaaatcccagcactgcaaaaacaatgacccatatgccaaaggtttgtcctgcaaaatgacttatttttctaatgatgtccataaaaacactcctaacacacttatcaagaacttcagcagaaattcttacaaatttcataacattctattattataaataattttctgaataattcaatattagtttttggcagatgtctatagatatatgatgtaaactaattaaaatgttcttgactatataggaagatattcttacaatgaacctttataatggttagatcaaataggagtgatacggtgaaggaagcaaatcaatggtcttcgaagctcggctttattttagccgcggcaggatcagctatcgggcttggtgcgatatggaaattcccatatgttgccggaaccagcggaggaggcgcatttttacttatttttattttatttacggttttaatcggactgcctttattgttaggtgaattcatcataggcagaagaacacagaaagatgccgttcagtcctataaaacacttgctccaggaacgaagtggcattggatcggttatttaggcatggtgacgtgctttattcttctatctttctacagtgtcgtaggcggatggattttaatttatattataaaaggcttcactggcggtttatcgcaaacatctggttttgatacgatatttgcaagtaccatttcaaatccttatttggctgtaggaggccagctgctctttatggtggtaacaattttagttgttgcaaaaggggtaagcagcggaattgaaaaagcaagccaagtattaatgccggcgctttttctattattcatcattttaatggtgcgttcggttacacttgatggcgcgatggaaggaatcaaatttttcctcatgcctgatttaactgcaattgatgccaataccattttatatgcaatgggacaatcctttttcttattaagtgtcggtgtatctgtcatggtaacgtatagcgcttatttagagaaacaggaaaatctggtacagtccgctgtatctgtaactgttatgaacatgcttgttgctgtaatggccggaattgcgatttttccagctgtattttcattcggcctcaagccagaccaaggcccggttctgttatttaacgttctgccgactgtgtttaatcaaatgccgttcggaattatctttttattagcatttttacttctatttttatttgctgcattgacatctgctttttcaatgctggaaattttggtcgcagtactgtcgaaaggcgatatcaataagagaaaacgattcgcttggttaggcggtattgctatttttattgtcggtgtgccgtctgcattatcatacggtgtcttaagtgacgtcactatatttcatctgtctatttttgatgcggctgactatcttgtgagcaatattttaatgccgttaggtgcgttactgatttcgatttttgttccgctaaaaataccgaaacaggatttgtttgacgagctgaaaagcggttccaatctcaagcgaaagtggtttgcggtttggctgctgctcattcgatatttatctcctgttgccatcatcatcgtgtttttgcatgtgataggcattttttaatacacgaagcccccgaggaaagggggctttttttaatagagcttccaaacgacttcttttgcctgctcaaaacgtttttcagcctcgcgccaatccacgacattccaccagtgatcgacatagctggcccggtcatttttgtattgcaaatagtaggcatgctcccatacgtcaagcggtaaaagggggatcacatcccattggctaaagagctggtgtttttctgcacttaaaatctccagccgtcctgatcgaggtgcccagaccagaatggcccagccgacgccttccacttttttagcggcctgggtaaaatgttctttaaaagcggaatagcttccaaatgaaaggtctatcatttggaacaatgcccctgtaggacgtcgttttccgtttggatgcatagaaaaccaaaaaatactgtgcaaataatggcctgctccatggaacgcaagctctctttcccaatgagtgattaagtcataattctttgttgctctcgcttttttaagctctgattctgctttgttcaggccatcgacatagctttgatgatgttttgtatgatgaaggaccataatatcgcgtgaaatataaggttctaaggcggagtatttgtaaggaagctttggcagcacgtgtttccctatagggacatatgcgcgtctttcacttgtatcatctgattctgtaatatcccggtaaagggcagcggcctgtttataccaatcttcttctgttgtttggtcatcttccagagcctcaatcatcttgtcgatttgatcttcaaactggtcaagctgtcctcgcttttgaatctgatctttcagggcttcacaccaattgaacatctccgtttgataagattcacgtttcatttgctgtctccttttcaatagaatctaaatatttcccgacagccagcaaagagaatacatatggataactgtgatagcgaatataaaattgcttcggcaatccgatccctgctggatacgcgaggctatcggcgctatgcgaactgctgtcggtaaggtattgcatgcctttcacaactgacggatgttcggaattttcatatgtgagcaaagcgtctaaagcccaggccgtttgtacaatggttcctctatgaagcggtacatatgttttgatttcggcgcttttgcaggattctccccagcttccgtcatcattttgtatggatttgagccaacgcagagccttttgtataccgggatgctttcggtcaaccccgcatgcatgcataccagtaagagcagcccaagtgccgtaaatgtagcaaacaccccatctgccgtaccaagacccattttgttcctgatgttcgaaaagccacttcactgcgcgttgaatatgttgatgtttttctgtgaagccaactttctcgcctaaaaagtgcagtacacgtccggtgaggtcggcggttgaagggtcaactgcagcgtcctcggcggattcaagcggcagaaggcggatcagtgggtggttcacgtttttttcgaaagcagaaaatccgccgtcattgttttgcatcgataaaagccaagatacccctcgctcccatgctgcaggagaatgattgcggggaatcgcttttaaaacggctgcagtgtcgtcacagtcagggttatttgtattaatgtttgaaaacccccagccgccaggaactgaatttggatttttgacagaccaatctgctattttggtatgctggcgttctagcaaaaagtcggctgcttttgtaacagagccatccgtttcggtcacaccatttttttgaagggcatagctgattagagctgtatcccaaacagttgatgtagagttttccagataaggaatcccgttgcatttagtcaccagtgatttaatgccggtaatcgccctcctgataacaggggaatagcgtgacacaccaagtgacagaaggctgtaaaccataaatatggttgcgctcgcatagctgtataatgttccatctttttcaatccggtccagcatatacgttttagctgtctgtaggcccagctgctgaaaagcaaatggtgcatgaaaaacgcgtttccaatgtgacaaaatagacgtgagatctctttcttcgaaagcatcagaccgaagccaagtgaaaggattttttgtcatgtgcggatcgagatggtgaagagatgaaatattgcggttaataaggacgaatcgctgattgagtgttacagccataggagcaaaatgaatacgggcatatgagctgaactgatagaaatgaatcggcaatgttggggggagcgccatgagtgataatggtaaatacaaagcaggccaaggataaagcccgttcgcggcaagcatccattttgtcataaaatgaacatgtctcaaaccgccatgtgagatgataaattgttcagctttcttcatgtgcggctcagatctgtgaaaacatcctgaagccagcatcccgacatatccttggacggtagccgttagatttccgcgcgtttcatcgggatagttgataaatgtgccgtctggctgctgttttgcatgaatgccggctgcaagggatgatatcagttctttttcattttcgccttcatctagtgaggtaaggagcaaaataaaaaaggaatttgtcaagattggtccttcaaagcaaaatgtccatgaaccatcagcattttgcctgtctcttaactcggtaatggttttcttttgaaaacgcctcactttctcctgaagtgtgcccatcacgctcaactccttcagaagcatatatattcagcgtcttttactgccattacagaaagaaaaaaactgctggcatgcagcagttttttaaacatacatgttagtcttcaaggtttatccatacacttttgacttctgtgtaattatccaaggcatatgatcccatttctcgtccgagtcctgactgtttataaccgccaaatggagacgccgcgtcaaacacattatagcagttcacccaaacggttccggcttgaagtcggtccgcgatatagtgagcctgcttgacgttctctgtccatagtccggccgcaagcccatattctgaatggtttgcccgttcaataacttcatcgacagtttcgtacggaattgcagtcagcacaggtccgaaaatttcttcttttgcgatggtcatttcgtcttcaacattcgcaaacacagtcggtgcgacaaaatatcctgcttcaaaaggacagcttccgccggtcactgcttttgctccttcatcttttcctttttgaatataggaaagaacgcgctcatgctgttccttgcttacgagaggcccgatttgagtatctttatgaagtcccgctccttggcggagtgactcagcataggacgccatttcatcaacaacttcatcatattggtctttatgaatgaagacacgtgagcccgcacagcagacttggccctggttaaacatcacaccgtttaaagcgcccgggatggcttttttcaaattcgcatccggcagaagaatattaggtgattttccgcccagctccaatgtaacacgcttaatgcttttcgctgcggtggacatgattttctttccgatttcagtggaaccggtaaaggcaattttatcaaccgcttcgtggttcgtcagcgcttctcccgcatcttcaccgaatcccgggatgatgttgattacaccggcagggaaaccggcttggtcaattaattctgccaaataaagagctgaaagcggtgtttgttcagccggtttgaggacgattgtacagcctgttgcaagtgccgcgcccattttccacatcgccatcaggagcgggaaattccatggaatgatctggccgacgacaccgacaggctcatgacgcgtataattaaaataagcgccggaaaccggaatcgtctgtcctgttatttttgtacaccagccggcgtaatagcgcatatgctcaatagccagcggaatatctccattagtcgtttcattgatcggtttcccattatcaagtgtttcaagctgagcaagctcagttttatgctcttccattaagtccgccagcttatacatcagtctgcttctcgaagctggagacattgttctccattcaccttggtcaaaggctttccgggcagctttaaccgctttgtccacatccgcagcctgggcttcatacagcgtcatcaaggtttcgccggtcgccgggtttggagtgtcaaaggttgcccctgaggcactcggaacaaactttccgtcaatataaagcttctttgttccctgtaaaaatgtctccagccttttcgtcacttgcatcgttaaagaactcatccgtaacaaacctccagtcattttttatggtctgttctgagattcttggtgatagcacattgattcctggattgaatagcagaaataagctgtgatagttgcttcaaacgtaagcgtatacaaacattctataatagaaatcaaggcaaaatcaatgaataaccgatattgcaatttacaaaagaaaaaagctacaataagcttatagataagaaaaggagatttcatcatgattcataaaaattggcttgaaaaagaaacaattaaaaaagtaaagtgtgtgcagacaaacgcaaaaaaatatatcgtaaaccgcgttttaacgccgggaaaagaatatgaagtaaaaaatgaaacagaggagtttctctttgtggtcgacaatacgaataaagtcggcggctattataaagaatacttcgaagagatgtaatgcttccttgaataatcaggaatattttgttaaaagtggtcaatccacaaaaccgcagctcagctgcggtttttttgtggttaaaacaggaaatataaaacaagaataaaaaatcattaaaaaccacttttttataaaaacattgctgaatattgaaacttttttctctatatgtgcgtattacttgatgacaacagcttaaaagccaaaaaacaaatcaaaaatttgaaaaatgtaatctgttcgtaatggtttaaatgtcttctatgtcgtattcttatatagggataaaggacttatttttatgtagtgaatgataaaacaaatagataaatgcagaaagaggggttcttcattgggtattttttctgttagcagatcaacggacgcaaagaagcttgaggctttgctcgttgaaggggaaagaatagaatcgatttataagctccgagtggaccaaatttgctttacaaataagcggatcattttctttgacaataaaatgttttctaaaaagaaggttcgtgtatttcttccatataaaacaattgaaagctttgccattcaagaagcgggaatgtttgatccggacactgggcttttattgatgacaagaagcaaaacgttcgaattagaatttgcgaaagacaccgatttaagcgaggttcaggcggtgctgacaaagcatttgtgcagctgaatatttgatgagccagccgttcaaaaaatggttaggcttttttttatatataaaaacaagaacagggcatgtgcgccctgttcttattacttattacaccacactgtttttcgctgagttcgaatcaacaagatctgcatctaatacatttgaaatcggtacgacaagaggagtaaagtcgccattttcttctccaaacccttgatttattttagctgataaaaagtaatcgacctgctgatacggaccgagtgttaaagaggaaccacggtccattgtattgattttaaatccgccgacattcacgacggagggagaaaagaacatctcatcacttccttttgattgaggagttaaccgcttcactttcaaaagagtccggagaatcaatttggtctctgtcatccacatggcttctcgtgcccataaatccgctcgcatctccaaaattctgtccgtagccttgattttttttatcagaattttgccattctgccaataaattttgtcctacgttaaccgctgaagcattttcaaaggaattaattttcagcatgaaaatattaatattgatatacggagttggttgaaccacaggcaaacctcctttctatagttgtatgctggcggttataaagtatgttaagacagggggcttcaaatggatttcgaaaagatgaagcagtggatggaattcgcacagcagatgtacggcggtgacttttggaaacaggtatttgatgaagaccaaaaaaccccttttatgacaaatggccaatctccgtttccgtttgcgcagcaagatcagcgagggaaaggagatgcttcatttccgagcatggatattgtagataccgttacggaagtacaatttttaatttatcttccaggctaccgtaaacaagacgttcacatattatcgtacggagattatttagtggtgaaggggcagcgcttttcctattttaatgaacaggactttcgccaaaaagaagggagatacggaagttttgaaaagaaaattccgctttccgatcatcttcatggaaagatgaatgccatttttaaagacggaatcctatacatcactattcaaaaagacgaaggtcaagcgaaaaccattgttattgatgattgattttcatactgagtgcatctgccccatcacggtcatcaattgattcaatcggaatgaccatgacaataacatctgcattttgttccccaaaaccgttatttcttttgatagcagagcgcctgttccttaactccgcagaaccaaaggtaagggatgagccggtgcctatcgagttagtcttgagatgagaaatattgatgttagtcggaagcatgaaaacctctcctttctatgggatatacctcattatatatgtagacgaaagaggagtatgcaaagggtcgtgatgtcatgaaaaaaatgttccggtcgctgatcaggcattgcttgaaaccagaacttgacaaactgcgtgaatgtgaagaaagactctcagtgattgagaaacaaaaacaaagcagcaaacaggagtctgaagaaacctatatacatattgaaacgctgaatgtcgaaaaaattgactatcatcttgaattcggcgagctgaccattgatgaactgagcggcagattaaatataggcgcaacctattatataccgccagaagagaaggacaaaaagtgccaacgaaaacccgaagcaccatcgacgccagcggtcacgatccgttcaaaaaggcagtagctcatctttccattgatgttcccatgtttaacagaaggcaaaacgggaaacaggatagaaaggagaggatatacatggcactgacaaaagaacaaacacagcatctctatcataaattgctcgatatgcaaaaagaattgtctggcgagaaaaaggaaacagaatcaatgacggaagaagtgggggagctttccaatggggttgacaaccatatggcagaccacgggacgctcgtcacagatcggatgacagaccaaacagtgagagagattgaccgggagctgttagaggaggtcaaccgtgcattacaaaagatgaaagacggaacttacggcgtgtgtgaaaaaaccggccaagagattccttacgaaagacttgaagctgttccttatgcaagaatgacagttgaggcccaagctgatgtggaggatgatctggagacagatgctccttcttatgaaagagagtttcatgaacaggtaaaagacttatccaacaaagaaacaattgatcaaaaaagctcgcagacgtatgaaatcttggatcgtgaacaagattcgaagtaaaaatgccatgcaagtacaccgatattagatgtacttgctttttttttgaaaaaaaatctcatattcaaaataaagtgattgactttgcgtaaaaaagaaagtaacatactatttgtaagtaaatataaaaagtttaccgggaggaatacagatgtctacagttttatttgtaaaatcaagcgaccgtacagctgaagaaggcgtttcaactaaactttacgaagctttcttagctgcttataaagaaaacaaccctaatgatgaagtggttgaattagatcttcataaggaaaaccttccttaccttggcagagatatgattaacggaacatttaaagcaggtcaaggaatggaaatgacagaagatgagaaaaaacaagcagcaattgctgacaaatatctgaaccagtttgtaaaagctgacaaagttgttttcgcattcccgctttggaacttcacagtgccagcagtgcttcatacttatgttgattatctgtctcgcgcaggcgttacattcaaatacacacaagaaggaccagtcggtttaatgggcggcaaaaaagttgcgcttcttaacgctcgcggcggtgtctactcagaaggaccaatggctgcacttgaaatgtcattaaacttcatgaaaacagttcttggtttctggggtgttcaagacttgcacacagttgtcatcgaaggacataacgcagcacctgatcaagcgcaagaaatcgttgaaaaaggtttacaagaagcaaaagatcttgctgcaaaattctaataaagccaagactcctatcgttacaaataggagtctttttgtatatacacattaatatagaagaaaataatcattcgcttttagcgaaaaaggctgttttttttattgtaatatattttttgtttgtcgaattgtcaggtattttggagaaaaaacagttttattcactggaaaaagtttttctaaacaattgttctgacctcttgattaaaaccgcctgatggtgtactatattaaagaagctactttgtgcgtattgttaattaagttttaacctttaagctgtaatagggagttttatatcgaagccggaatgtcatgcctccattgcagaggacgacaggaacgtttctgcaaacacccactttgaggagtggtggtttaaaactttcttacttgcatacggcaagacgtagcgaaagccatttccttttcggaaatggctttttattttatctaaaaaggtttggtatagtgaatattccatttttgtgtgaaagaaatgaaggccgcttttttatgatatgatgggagaaattcaaggaaaagcgaggtttacacgttatgttacatagagcccaatcccttctggctcattattttggttatgagaagtttcggagcggccaagatgaagcgatccgcttggtgacggaagcgaggcaaaatacggcctgcattatgccgacgggaggcggcaaatcgatttgctatcaaattccggcactaatgtttgaagggacgacgatcgtcatttcaccgttgatttccttgatgaaggatcaagttgatgcgttagaagaagcggggattaacgccgcctacattaacagcacacaatccaatcaggaaatatatgagaggctgaacggactcaaagaaggggcttataagcttttttacattacaccagagcgactaacgtccacagaatttatccggattttgcagggcatagatgttcctttggtcgcaatagacgaggcgcactgtatttcacaatggggccatgatttcaggccaagctacaggaatattgaaatcttgttccgtgaattacacgacaagcctgtcatcatggcgttaacagcaacagccacacccgaggttcatgatgatatttgcaaacagctgcatattcaaaaagaaaacacggtatataccggattttcccgagagaatttaacctttaaagtagtaaaaggagaaaataaagatcggtttatagacgaatatgtgcaaaacaacaggcatgaagcaggaattgtctatacagcgaccagaaaagaagctgatcggatatatgagagattgaaacgaaatcaggtcagggcaggccggtatcatggaggtatggctgatgatgagagaaaagagcagcaggaaaggtttcttaatgatgagcttcaagtgatggtggcaacctctgcttttggaatgggtattgataaatcaaatatcagatttgttctgcatgcacaaattccgaaagatatggaaagctattatcaagaggcaggacgagctggacgggacggtcttgccagtgaatgtgttctcctgttttcaccgcaggatattatggtgcagcgcttcttaattgagcaatcagaacatgaagagaaacaaaagcaggatttaaaaaaactgagacaaatggtcgactactgtcatacggaagattgtctgcagcgttttatccttatgtatttcggagaaaaggagcctgatgcgtgcggacagtgcggaaactgtaccgatacaagagcggcccatgacgtgacgcgggaggcgcaaatggtcttatcctgtatcattcgcatgaaagaacggtttggcaagacgatggttgcccaggtgcttgccggctccaaaaataaaaaagttcttgaaaacggcttttcagacctctcaacatacgggatattaaaacaccaatccgttggcgaaatcagcgattttatcgaatttcttatttctgacgacttcatcaggatgtcagacggaacgtttccgactctttttgtcagcagtaaaggaaggaatgtgctgaaaggagaattatcagtagcgagaaaagaatcgttaaaagcggcagcgattactgaaaatgacgagctatttgaacgattgcgcatggttcggaaagaaattgcggctgagcagggtgttccgccatttgttgttttctctgaccaaacgttaaaagaaatgtcaggaaaacagcccgtaaatgatgatgaacttttgtctataaaaggagtcggagaacaaaaaagagcaaaatacggccggctttttttacaagaaatacaagcttatgcaaggatgacagactaaaaaaacagaaaaacaatctttttttctataaaaaacacattttattttctctgtttcgcctcaaaataaaaagacctgcgaagcctattatatcaagggttcagcaagtctttccatcagagagaaatccttcatgtaaaggaactgtaatctaaatcatatctttttgttattgatttgacatttacgtgtgttacgatatcacctgttagccgccaataaaaagctaacaagggaggatttacttatgaagaagacgattatgtcctttgtggcagttgctgcactttcaacaactgcattcggagctcacgcttctgcaaaagaaattacggtgcaaaagggtgatacgctctggggaatctctcagaaaaatggagtgaacctaaaggacttaaaagaatggaacaagttaacttctgataaaatcattgcaggagaaaaactgaccatttcttcagaagaaacaaccacgactgggcaatatacaattaaagcgggagatacgctttctaagattgctcaaaaattcggcacgacagtcaacaacctgaaagtttggaataacttaagctctgacatgatctatgctggatcaactctttcagtaaaaggtcaggcaacagcagcaaacacagctactgagaatgcgcaaacaaacgcacctcaagctgcgccaaaacaagaggctgtgcaaaaagagcaacctaaacaagaagctgtacaacagcaacctaaacaagaaacaaaagctgaggcagaaacttctgttaacacagaagagaaggctgttcaatcaaatacaaataatcaagaagcttcaaaagaactaacagttactgctactgcttacactgctaacgacggcggcatttccggcgttacagctacaggcattgacttaaataagaacccgaacgcgaaagttattgcggttgatcctaatgtgattccgctaggttctaaagtttatgttgaaggctacggggaagcaacagcaggagacactggcggcgctattaaaggaaataaaatcgacgtatttgtaccaagtaaaagtgatgcatctaattggggcgtcaaaactgtaaatgttaaaatcttaaactaataatatagattgtggtaaaagacatgagcttttggcttgtgtctttttttcgttctgcttagagctgtttatatcatatgctgataaaagaaagtggtcccgtttttctctttatgtgcgattcaggggctctcgggttaaaagattgattccacattacagagacattcggcatcatgacatttatagctggttgttactatctttgatcagcgaaacgagctggtgttgtatcttttttggcagataataagcagttggatgtagcagatgccattgacggattcggattgatttcagacggttctttattgtgttattaggctcttgcagttgggcatggcagcttcgggagcgaagtggcacaactttgtcatactgaaaatacaatataatcaatatcagaaattctgctgatgtgcaatggccgaccattttaacagggatatcattcaatccagtcttttattgggctgttaaccaagcaatcgttcagcgggcataggagcgaggatatggatcagtttaattcttctggttgcggcgaggttctcaaacgggaatttcaggttaaaaaaaggatcctggcagatgccaagatccttttttatttaaaccagcctttttcctttgaccgggtaatggcttcaattcgatttttcacttcaagcttttctagaatcattgagatataattccgcaccgtcccgcttttgatgctgagttcctgagcgatttcttttgtgtttttaccgtcagccacaagttcaagcacttctttttctctatctgtaagagggttagcttcgctgtataagtcctccatcagctcaggtgcatagattcgttttccgttcatgacgctacggatggcgttggccagctcttcactcggactgtcttttaacaaatagcctttaacaccagctttaatagctctctgaaagtaaccgggtctggcgaaggtggttaagatgataattttgcagcctgtatcttttagctcctcagcagcttcaagccctgtttttccgggcatttcaatgtccataatacatacatcaggctggcgttttttgacaaaatcaacagcatcttggccggttgtacctttgcctacgacttccatatcgtcttcgaggtttagaagtgatcctaaagcgcccagcagcatttgctgatcttctgcaataaatatactaatcatataagccatcctttatgtttattttgaattattaggaattgccatggtaagcttggttccgttttcggtattgatgtgaaggcttccatttgcaaactcaagccgttctctcatcccgagtaagccatgtccttttgaaaaggaattttcttctcctttgaatgttccatcgtcagacactgttatcacaacttccttccagagctgctgaatgtcaactcggcaagttttagcctggctgtgtttgacgacatttgtgacagcttcctttaagcacatactcaaaatgttttcattcagcaatgagatattttcgggccatttctcttcttcatagataaacataatgtcagctgcttcgagaatttgtttgatgttgatcaattcatccttgagccgtatgcccttcatagaggaaacgatttttcttacttcatttaaagaagttcgcgctgtttgctgaacacttttcagttcacgagctgcttgttcgggatctttgtatatcaattttcttgctaagtcgctttttaaaccgataagagaaagcttttgcccaagcgtatcatggagatcgcgggcaattcgctgacgttcttctaattttaccagttctgcaatccgttcatttgcatcctcgagcttttcttcaagccgttcgcgctccttgcggcttcttatactaaagggcaataaaattgcgctgatgagggtaatgacgacaaaaggaatttgtgtcagaaagaattccttttttaatacgagactgaaattggctgcgacggctgcgcttattaaatggacataatataaaatatgaaaagggacgcgttccttaatgtttccaataaaatacgcgataaaaaaagcaaaataaatataactgaacagggtaatggaggcggttgaaatgccaattaataaaaatccccacaaataaatggtccagccttttgagacaaaagcaaatcgatataccgaaaaaaataaaagcgtcaaaatgatgccgacaataataacaaatgtagatgatgatttccatataaagtagaaggggaggatgaaaaatatcgtccatatatagggcgtaatcccgtttagtttttgaaatgtaaaatgatttttaatcatgatcttacctcattttcagcttttcatcttacttgtaactttatcattgtgaaagccagaatgcaccctccaacaataaaaaggaagccttctagtatattagaagacctcctttatcatcaggcattcttccgcagcttctgtttttctggtgaatcaggcggaaggcttacaggtatatgttttatagcccgaaatgacacaaactgtttgttatcttcatcccaaagacggaacgcgagtgattgcaggcttgtttttaaggtgattgtcggtacgttttttaatggttcgtgatgttcatgagcaacttcaagcttatagttaggcacctttggactcaaatgatgaacgtggtggtaaccaatattgcctgttagccattgaagcagtttcgggagtttataaaatgaactgccttcaacagcagcctgaacgtagctccagttttcatccgcttcaaaataagaatcttcaaaggtatgctgcacataaaacagccaaacaccgattgaacctgaaatcagaaatatcgggccttgcaccagtaaaaacgattgccagccaaagatcagacagcaagcggcagccaacgcgacaattgccagattcgtaaggtatgtgtttacacgttccttgcgtcttgcgccttttttgttaaaacggttcgtgatcagaaaaacataaatcggtccgagaataaacatgataaacgggtttctataaagtctgtatgcaagctttgttcgtcttgatgcagctttatattcgtttactgttaacatccagatgtctcctgttccgcgtttatccagattgctgctagtcgcatgatgaatcgaatggctgtgctgccattgaagatacgggaataaagtcaggacacctgtcagaaaaccgagaatgtggttatagcgtttttgtttgaaaaaagattgatggcagcagtcatggaagatgataaaaattcttgtcagaaaacctgcggcaatcaccgttaatgctaacgtaagaagataggagacatcgaggctgagataagcaagaaaccataggccgaagaatgggataaacgtgtttaaaagctgaatcaggctgttttttgtttcaggctgagcaaatgcagcgacttgctttgtcagctgtttttgtttatgtgcaatggtttgttcagtcatagtaagtatcctctcattgtgtgtctcggttcagtatacgctaatgagagaagtcttttgtagtagcacacatcatgcctcctatatgacatttgtcatgtctcgtgcggcatgcataaccgattgcgctaaaaaagcttgtaaaaaaaatttacaagctgattaatgtttatcaatccatatgcgtgatgtacccgaaatagcttcaatcctgcatgttcctcctatagggaacgtggcaattggcgaggtatgtccggcatttatatttgcgatgatcgggatgccggataattctttttttgtttcgatcatggcttttacaagatccattgatacgtttgatgctttctgaaatctgccgatcaaaatcgcctttacatgtgaaaaagcggggaggtggatgagtgattgcagatcgcggtcaaacatatggatgtctgacatataatcatcttcaatcaataaaatagtatgttctgtttcaggaaaatactccgtaccctgcagcaaattaagcgtgcataagtttccgccaattaaagtgccttccgcataaccttcttggattacaacagggccgttattaggataaaaacgcctgttttcttgatccaaaaaccagcgatcatcgctccactcacttgaaggaagaatttcaaacgggtcgtccgaagcgcagcaagaaagaaaatactcttgtgtataatcaagcccttttttcattgcaaatgttgagaagtggggacctgaatacgtaacaagacccgttttttgataaatagcgttgcaaagagcggttatatcggaatagccgcacagaatttttggatgtcgtttgatttgctcgtaatcaagataacgcagcaactgatttgaattaaaccctccgagtgtcgttaaaatcgctttgacgcctggatcaaaaaaggcagcgtgcagatcatggactcttgactcgatagaggatgaatcaaattcgttacattcatttgcgtgttcagcgatggttacccgataacctaagcgttctaacgccgtttttgcttggatttttgcttcatttgttaatatagacatgctggtcgcgggagacacgatccggatttcgtcttcctttttcagttttgaggcgtacatagaaccctccatcaatggttttataccattacagcatatcttggctctttcttccagacttttttacaaatcaacccacttaatgctgccggattgggtatcatgatcgatacatactttgaagtgatgtttttcataaaaatgaatcagccggtctacatgattccaatcccgtttggcgatgtctccggtgactttcggtatattatggtctcttgcaatatcttttaaatatttcatgcaaatggagccaaacccgtgattcggagggccttttatatcccctatatgaatggcatcgtccttgtaagacgctacaagtgaaaaacagccttttcctcggtatgccgttttacaatcagttagcataattttgcatgtttggccatcatcaatcgaggaaacaatcatccactcatcatgtttcgattgatcaataccaagcactttggcatctttagataaatccttcatattctcctgcatgcgataaatttgaaattctaaatcatttagttcttcttcaagctcttgacgatttttttctttaatagtaaacaagatcaaactcctttcaaaaatcagcttagaaacacagttaccaattgtattagaagagaggcgtattgtaaacaacaattccattattactagaaattagcggaaagtcaggtttgatcgtttttaagagaggaaaaagaaaactaacctgtgaaaaggaggaatcggaatggcgattgattcattgattaacaaattacagtatgtccaattggaaccgccggataaaattctctctctgtatctcaatacagacatgagagatccagagcagcaggggggagaatggaagattgccctaaagtcaggattcagccgattaaaagagtatttggcagctagtgatccagaggaggaaaagtgtctggatggaatcagggctaaaatgaatcaatacttgaatgcaatgggaaaagacatgccccgcagtctcgtgttttttgtttccgacagcggcatatgggaacctattaagcttcaagtccctgtagatacaagattttactgggaagaaacagctgtcctggatcagctgaaggatttgcgccaggcatacccaagtacggcgtttattttaactcagcagcatgaagtgaaaattattgaaaccgttttaggaaaaattgaggcggtggagcgttatgagtatgatatgatcaatgagtcttggaagaatagccattccgctgtagacaaagcgccaccatttgaagagaaccggatgagggaacatgtaacagagaaccaatcgagactgtataagcggctggctgccagccttgatcaaaaagctgccgcgaaaagatgggaacgaatggttattgccggggataaagaaacggccgatatcttggatcagcatatgaataaacccattcattcgaaaattcaaaagaacctgctgaatgaaaatgaacataaggtcattgaacatttgataaaagaggcgtaaacctaacaggccggggctaatagcctccggcctttgaagtgtgtctaatttctgacgaagcaatcgaaaccgttgacatcttctttgaatttgcatacgatttggatagccagtacaaattaggagaggtcaccaaatgaaccaaacagaaaataaaccgaaaaattacacggggattgtccttacgctgacagttctgattaacggtttaatcgcagtgctgttttttatgcctaaattagatcagttcagccatgcgaatattcacattttgccaatgctgaatgcgatattcaacagctttacgtttatcttcttattggccgcgctgattatgattaaacagaaaaatatcaaagctcacaaacgctttattttggccgcattcacaacaacattactatttttgatttgctatgtgacgtaccactcgattgcggaaaacacgctctatggcggagaaggtattatgcgcccgatttatttctttattttaattacacatatctgcctttctgcaattattgtgccgcttgcgctgtttacgctgatcagaggcttcagcatgcaggtggagcgccacaaaaaaattgcgagatggacaatgcctctatggctgtatgtaagccttacaggcgttattgtatatttgatgatttcaccgtattattaaaagccatactcagtatggcttttttacgtgtaaacatggcaaaagcccaaattcatttttgggcttttgtcagtaaattgatagactcttattcatgagccttggattccatggtttcaagtgttgcaacctgcaaagattcttcaacagtttttgttttttcttttactttttctgcatacgtataatcaccgtagcaatacggatagcggaaatttttcgcatttcccccgcaagtatacagatcaggattttttttgacttgctgctcggagtattgttttgccaattcctcagtatgcgttcctccatgttcagctacaaaatcaatgtaacctgcccccatgttgtagctttgaataatggtatccaaatccacgcctttttccttaccggtcttgtacatgagggtaaattgcttgatgccttgtttaacactgagttgagggtctgttatctcattgcgttttaaccccagagattcagaggactgcatgggatcattgccttttccttttgactcctgatacatcatgcctaatatgagtgatgtataattagagagtccttggctttcaagctcttcttccaccaagggtttgtaatcggttaaacgttccaaaacaatcgttttcgtatcgatcggaagttttttgactaaatcccggttgaaaaaaagcaggaccaataaaaaagaggcgatgacaaagacaaaaatcatcataaaacccgcagcagcgaaacagccttttctctttttcttcactgtgtttcaccctcaatgtttggagcagtatgaccttttttattatgacataagacggtatatcagaccaagtaaaaacctgatttgaaacataaatttaaactatgagattgaaatggaatacaagcaggctggtttgcactcaagcgcatttgttataagataaaactatgaataaagaaaggtgataccatatgactgaatttagagaaacggaacaatcggctgctgatctggacgaggagacgctgtttctagtcgcgcaaacattcaaagcgctttctgatcctacccgaatcagaattctccatttattgtcccagggtgagcatgcagtaaacggaattgcagaaaagctgaatttactgcaatccaccgtgtcccaccagcttagatttttaaaaaatctccggcttgtcaaatcgcgcagagaaggaacatcgatttattactctcccgaggatgaacatgttttagatgttcttcagcaaatgatccatcatacacagcatgattgaaaaagacatccttgcttaactcgctgctagcgggcaaggatgtctttttctttattgtgtccgtgctgttcgagttcgtttctgctgagcttgatgacaaaagaagaaaaaccgatataataaacggctatcagaaaacagacgccaattgtcagagggtccgttccgattgactgactgtatgatccaaggcggtttagatcaggtgaggtaagataaagctccgtcactcgatacagaaatcttgatagaaataaagttaagagaatcacctctacccaaatatgagtccgaaaatagatctttcctctgcgtttttcaaaggagatgtttttcttagcgaaaaagacaaggagccatccgccaagaatgcccaaaatgagatatccatataaaaaagggtgaatggcgctgaagattgaaaggccaaaagcaaacagcgagaaaagaatgatacgggtgaacagccagcggggcttcagcggctggtatccgatggaccttttaatttttttatacagaaaaaagatgatgatcatggcaggataaacgctctgaagtgtaagatgcatgatgtgaaatcccctccgttgagaagtgtatgcttatccggtcagaaatagtagctgaaataaatactgaacacaaaaaagaaggggaaacccctgttttcatagcatatgcaaggtgtattccgccgcatgatagatatgcccaagcgttatcaaaatgttatgattgtttttgttggaaaatacaagaagaaaaggtgcgcagaatgaaactggaacgtttgttagcgatggttgtgttattgatcagcaaaaaacaagtgcaggctgcagagcttgctgagctgtttgaagtatctgtcagaacaatttaccgtgatattgagacgatcaatagggctggtattccgattgtgacctcacagggttccgggggcggaattggcatcatggaaacgtatcggcttgaaagagagtggctgaaggaggaggaattgtttgcaattgcttccgctttgcaaagcgtttcatctatgtatgaaccaatttctcacagcacagcctatcaaaaaatcaaacaccttatacctgagcaatctgctcaagcatttaagcaccaaacagaaaaatggtttattgacatgacggcatggggccataccgaggatcaaaaggcgcttcgtgagaaaatcagcgccgccatcgatcggttgtcaacgatatcttttacatatacaagcgcaagcggggaaacacttcttcgtgaaactgaaccttatacattggtttgcaaggcggggcactggtatttatatgcctactgcctggtaagaaatgattttcgtttttttaaactaaaccggatgaaagatctggctatcttacatcagacctttatcagaaaagacattcagctggacactttgccatgggataagaattggtaccagaagggccgtttaactgaattggttattcttgttcagccggcagcacgtcagcgtataggtgaatggttcggatatgatgtccttcactgtgaggaagatgaaatctgccgggcagtgatttcacttccagaagatcaatggctgatcggttttttgctccagttcggaaaggatattgaggttctgcagcctcttcatatacgggatagagtaaaagaaaccattcatcacatgcaaaaaatatatgaaacctgacacactgctgtcaggtttctttgtctataatcttaaaaaaaggaggagatcgtatgggcttttcacatataacacacttagaccggaaacgatttgccggactgtcacaacggacaagcaacgcactggaaatgacggaagaaaggaggattccggcactgtgggaccaattctggaagcaggatatgagcgctcttttatcacaggctgaaaaagacaagagcattattgccttatattcgaattatgaacaagagacgaatgggttttatacgttttcagtcggaacgtttcaggaatacgacgacattcttccgggaccatatgaaaacattgatttgccggcttccgcttacgccgttttcacttccagaatcggtcctattgaagagattgtgcttgaaacgtggaaggaaatttggacttgggataagcggcatctgcgcacgtttacaggtgattttgagatgtatgatcaaagtgccgcagtaccacagcgagcacaagttaacatttatgtagcgataaaaaaataataaactcttgaaaaactaatggtgttagttaataataaaactaacgccattagtttttgttaggagggtaaaaagatgagaattactcagtaccaaacggtttggcagctgactttttttccagcattgtttccggttaattgctatttagtagaggaagaaaacgaagtcacccttattgatgccgcactgccaggcagctataaagggattattcaagctgtgaatcagcttggaaaaccgcttcagcatattttactgactcatgcacatggggaccatgtcggatcactggatacattggcacaaacatttccgcatgcaaaggtcatgatctcggaacgggattcattcttgctccaaggtgacacatccttgcggcaagatgagccgcagacgcctataaaaggaggtattccgaaacacatacaaacaaagcctcaccaactgctgacgggcggtgaaacaattggttctctgcttgccattccaacaccgggccatacaccgggcagcatgtcatttcttgatacaagaaacggcactttaatagcaggagatgcgtttcagttgcgcggaggaatcgctgtatcaggtcagataaaatggacgttcccttttcccgctttcgccacatggaataaggaggaggccatcaaaagtgcacaattgctcgccgataaggcgccttcctgtctcgctgtcggacatggaaatttcctgagatcacccgcagagcggatgagacaggcgatccaaaaagcaaagaaaggatgatgagcatgtcaccgagaataggtttgacccaaaaaatgattgtagacgctgcagcggagattgccgatcaggaaggggtaaatggtgtctcacttgcggcactttctaaaaaaatgaatgtgcgccccccgtcattgtataaccatatcaacgggctgcaagcgatcagaacagaacttgctgtcagaggactgacaaagctttttgatcaaatggcggactccgtaaccgaacgaaagggagattccgctatgctttctttagcacatgcatatgttgattttgcaattgaaaatcccggatattatgaagcggctctgcttaaggttcaggacaaacggacggaaatcgtctctgaccaaattgtctgtcttgtgacgaagctgctcattgaaaacggctatgcaagtgaaaagactgccattcatgcgacaagggggcttagaagcctgctgcatggctttactgctttaatcgcaaaagaagcatttgaacgtgaagaggacattttagaaagcctgtcattttcaattcggacatttttgtcgggattattaataaacaataaaaatattatgtaaacaaacaaatggatgtcttatatttctgaatattgtataatatcaagggagtataaataggggagaggcattatgcaatggatgacattcacaagattgaacgattagcggcagcttcatggccggcttattttcaaaaaagcatagggcaatggcttctcagagcgaattttggcgtaaccaaaagggcaaatagcgtatggacgtctgcggatatgcctgaaggggattttcagctagaggccgaacttttttatcaaagtttaggcttacctgtttgttttcatattagcaacgcatcaccgaaagggcttgatgacgcattggcagacagccgttatgaaaaggtagacgagtgcttccagatgacagcgttgtgccggtcaattatgagccgaacaaatgacaacagccgatttacatacaagtgggaacaagagccatcatctgtttggatagatgaatttattcaattagaagggttttcacccgagcgtcacaaaggttacaaacacattttcgaacgcatgccgccgtgtaaaacttttttcaagatgtatgacaaagaaagcctgacagcgcttggcacggtttctgtcattgatggttatggcggacttagtaatatcgttgtagctgaggagcacagaggaaaaggggcaggaacccaagtgatcagggtgttgactgaatgggcaaaaaacaacggagcggaacgcatgtttttacaagtgatgaaagaaaatctggcggcagtttctttatatgaaaaaatcggattttcgcctatatcggaacaccattaccggattaaaagatgaccaaaggaagggggttgctgatggattcgcttcaagagatgatttgcgaaaaacggacatacacacgcctatatcattcacataagcacgcgtacagccaatttctttttccgcttgaagggagtatagatcttgagactgaggggcgccaggtgaaattaaatccggatcattttttatatattccgccgcagtgcgagcatcgcttccgttctatcggaagaaatgaatgtcttgtactggatgttccgcttcatgcaatgaaaattgatgagtttcgtgcaggatcgggaattgaagctgcactcgatcctttctggtcttcgatcaggtacttgctgacagaggaagcaaaggccggaacagccaactcgcttcatatgctagtacaatacataaaagaaaagcttcaatcccatagctatgcctcaattgcatacattcacagccatttatttgagcggctgacgattaagaagctggcagaaatcgagcattatcacccagcttactattcaagctggttcaaaaaacagacagggaagtccccgcagaactatattgccgaccttcgccttgaggaagcaaaacgaatgctgatggagagaaatgaaacccttaccttcgtgagcggggcgctgggctttcaaaacctttcttcttttaccagatggttcacaaaaaggacaggaatgccgccccgcctgtatcgaaacaccttatattcagataaaaaataatggctatttggttaaacgaatcttgaatatctcctttacaataggagaaaaaggagttattgatatggcagtcattgaaaactttgagaaattggatatcagaacgggaacaattgtaaaagcggaagaatttcctgaagcaagagtaccggcaatcaagcttgtaatagattttgggactgaaatcggcataaaacaatcgagcgcgcagatcacgaagcgttatcagccggaaggtctcgtcaacaagcaagtcatagcagtcgtgaactttccgccccgccggatcgccggatttaaatcggaagtcttggtcctcggcggcatacccggccagggcgatgtcgtccttttgcagccggatcagcctgtttcaaacggcacaaaaatcggataacacaaaaaagacgtttgcctaaggcaaacgtctttgcgtattgaggcgatgcaccacacgccacattcgtgtgtgccataaaggcgtgtacatcggcttacacaattcagctcatcgctatatgaatatagcatggagggcgaaggaatgcaaggattactttgtttttgtgattgaatttgtccgtctaatcaagatcttattatatgaaatgtaataatcttttagtacagaaggtgagcatgatctaaggtaagcgattgacctcataagcaacacgtattccagattcaatcgcgccttgcatccacgcatgagtgagtgaggcgtgttctccggcgaaatgaactctgccctcagggacaggaatatagggatacagctctaattcttgtcctggttcgaaagctgtaaaacctcccgcagaatacgggtactggctccagctaaaagaagtgccagacacaaattcagaccacacaatatcaccatagatttcagataaattcagtaaagtatactggattcgctctccttctgaaagactgtcccatatcagtgcctcatcagcccaagtataactggccagaatgacggcatgtccatttgctccaatatttctgcttgaataatacgaaaaacgaatcggtagatcagtaatagatttgccgccgcgctgcccggctttttcccaaaatcggcttttaaactctatgccgatttttgttgcactgatatagtttagctcacggattgccctccgtttatagtacgagaatgaatggtatggttcgacttttacaaatcgcaatgttgaaaaaggaatggttacaatagcgagatcagctgtgaatgatgtgaattctgccgtttgttgatgctgacaatggatcgtaacactattttcaccctgagaaattttcatcattttttgatggtatagaatgtttgtttttaattgaggaagaaacgcgtgaggcagcagatccatgccgccagttatctcatagaagtgagcgggtgaagaaaaaaagatagattcccgcaatacttcaacaagggacatccccatatacgcttccatatccaaaagtacaccgatcatatcgatcgcgccatatgaaaaatacgtgtttaaaaaagagcttaacgaatgatttttgtattgttcttcgacaatccgccaatttctcgctggattttgattgataaaatttagaataggctgcagtaaagaaagcatcagctcttcagatgttttcccttgttcatttggtgcaactgggtatctcaatattccaggagctcgctcaaaaacttggagacgtgttttgattccatttgcataaatgatgtccataggggttctattgataaatacatttgttggcaatttgaatttttttatatactctaaggttaacgaatggttattcggtatgcgcatcgggccagcgttgaaatacaaatcatcactaaagggagatcttaaagtgcagacacggccgcccgctctgccgctcgcttcgagaatcgttactctgtgaccggcatttttcagcaaagttgctgatacaagcccggacaatccagctcctataacaagaatgtgctttggatgctgcgatgcgctaaggccatttctaatgatctttaccatgtcatcattcattagagaattcaatttttagaggcacctctttttagaatttattgcattatattcactgaaaagagcacctatcacgatctgttcacatcttttggaatttgaaaggttattgttaaaaggaaataaaggggtgatgtatgtgactaactttgttcataagacggtaaatggcttgaaaagtcttttagatgaaaaaggagccattaaattgttttgttcagaaggtgatatcatggagttccttgttacattttcaccggacaaagcaaccctgaatgacattcaaagctttgaggctaaacaccagcttacccttccagaggattatcagaagttcttgacactacataacggtgcgaaaatttttgaaattctttctgatgaggagaatataggtggaggactttatttatttagccttgaagagattgaagaagaattaaaatatgaggctttgtttgaggggatcaatggtatcccaattggtcacttattagaagggtgccatttgatgatcgacaaagataaattggataaaggggatcccaactatctttttatattaaaaataggggaatatacaccattaaatttaaattttgagatatttctagatcggtatatagaatccaatggggcaactttttgggaatggcgctactataccgcagaaaattattatagaacaaggtagcacgatgtttaaggcggtcattttcggctgtctttttctgttattcaagcaaatgattgtggtaaaatttacataaagtaggcttgaaaggagaatgatatgaaggtatttgaggctgattcattactctttgaggccgataaaagaaccaaagagtataaggaactaaggtcgcaaatggtgaagctaagaaaagcttttcaaaacgtagctaacctagatgacagtgagttttcaggcaagggtgctgacaacattaaagcattttatcatgatcatgtcggtgttactgatcaatggattgatttaattgacatgaagattgctttcttaagcagcatgtctgcaaaacttgaagatgctaagatgtctgatgcttacatagaagaatcctttttagaacacgagttggctaacgcctatacaaaatcaaaatccattatgtctgaacagaaaaaagcaatgaaagacatattaaacgacatcaatgatattcttccccttgaaatattttcaacagaagacttcaaagacaaactttcttctgcagatgacaaacgtgaaaaaacaatcgataagctaaacaagcttgatgaggatttaaaaacagaatacgctgaaacagagcctaacgaacagttcatccagcaagattttaaaaagctgcaggaatcaacaggcaaagggaagaacgccactccgattcactataacgccaaagcgtatagagaaagtgacatacataagaaaaaaggcgacatagagaagcattctgaagcttacttaagcgtgaagcaagaagaagctaaagaacgtgaaatcaaggaattaaagaaaaaacttaatgacggtgtctctgaccctgatgaatatttagagattgctaagaaagtagggtacgagaatctagagccagctcaagtacagcttgcaatgcaaattgaacaagcgaagcaactagaaggagcaggagaaatcacttgggatatcgtaaaaggtgtaggagtaggcttatatgatgtaggaaaagacactgtaaccggcatatgggacttcatcaccgatccaggagaaacactcttagcgctgggcaatgcagttattcatccagtcaaaacatatgatgccatttcagtagccatagaagagtcatatcaaaaggatatggtgaatggagatgcctattctagatcaagatgggttacctatgctattggttcagtggctgtagctgttgttggtacaaaaggtgcaggagccattaacaaagcagatgcaacggggaaggtcataaacaaagcaagtcaggcagggaagaaaataaaagacgtcaagattccagatttgctgccttataatcctaagtacgactttgctatggcagggggcgtgccatacaatgtggttgatagccaaagccttaagaatgaacttttgactaatgcgaagaaaataccggatggaacaagaaaaccgtttactggccaaaagataagccccccttggctaaataaagaaaagtatgaagcatatgaaatagaggggaaggtaaaggcgaaggggaaagttaaagatgtaagccgtagagtgtatactatgaaagatattgatattaatcaaaaaacagaattcggtgttacaaatcttcagcttatgaaaaacgggaatgccccttatgcaaaagatggtacacagattaatttacatcacttgattcaagaagaacctggcccaatgcttgaaatcccgaatagcttacatacaaaatatagtgatgtcattcatcagctaaagtctgatggtgaaagttttagaaatgataaggttttaaaagcacaatacgagagttttagaaagagatattggaagtggagagcgaaacaatttgaaaatgagaattgaggtgtttatatgatttattcgaaggttgagaactttattaatgaaaataaacaaaatgctatatttacagaaggcgcaagtcatgaaaacattggtcgcattgaagaaaacctccaatgcgatctccccaacagttataaatggtttttagaaaaatacggtgctggtggtttattcggtgttttagttttaggctacaactttgatcatgcatcagttgtaaataggactaatgaatataaagaacactatggccttactgatggacttgtggttattgaagatgttgattactttgcttactgtctagatacaaataaaatgaaagacggagaatgccctgtagttgaatgggatagggtaattggttatcaagatactgttgcagacagctttattgaatttttttataataagattcaggaagcgaaagatgactgggatgaggatgaagactgggacgattaagcaaaagtattgcaattgatgattaagctcttgctaagagacttttcttcgattacgagttggcgtagtaataaattaggggcagttttatgtgggtaaatttattagaggaaattcaaaaaactgaagcaaagtatggagatgaattaaattctcctgttacagactaagaaataagaaattttgaagaagcggtattaggtaagttccctgtaaatgaaattccttcaggatataaaaaattccttcaaactgtaaacggattagattttaatggcttggtaatctatggattggatcaagaattactgagagaagaaaatgatgaagaagtttatggttttattgaaacaaatgaacagtggcacgaaaatgatgagcagaaaaaatatctgttttttggtgactcaaatacagcttggtattgtttagatgtaattcagaatgaatacttagagcttgataaaccctctggaacactgatgaacaaatttaatgattttaacgccatgctagctgatgcattgaaagttagtttagacaattaaacaaaagtattgcaattgttcattgctaaagatgtgcaatgcggaggggattaatatgagcttcaataatgtcaaacaaaagttgaaagagtttttaattgatgcaaaaacagatcccagaatcaataaaaatgaacaactcaaagaaattgaaatgaacataggaaaacaattaccttctgattataaggactttttgaaggaatatggcggctgttatttagaaagtaaaaaaacatcagatgagattgagtatgacgtttgctataaacctatagagaaagatccttggatgggcaagggcgatgatacacaattgttagaaggcttttatggtttagcgaacgatcatgacagtcttcagaaagcaatcgatacatattctgatcgctttcttagaaatattattcctatcgcaagctctgcaggcgggaatgaaatatgcatggatatcgataatggaaagatattgttttgggatcatgaattaagtcatcccgacaaagactttttcttaattgccaattcatttgaggagtttgtcttcagtttagttgatgaaccaattgaagctgataaagaagatgatggaattctgtatattgaattagatgatgacttactaagcagttaagaaagcgtatggaaataactggaggaaaagttaaaatggcagttagttattggacaggggagaatcttacactgcgagcaattcaacctgaagatatcgttatatttgattcgttagatgatgaaattctgcgaaatatggactcgctacattttcctcgttcagctaataacatgagagaatgggtagaagaacaattagaaaaagatgaattccgttttattgcagttgatagtgataataatatagtaggtataattgaaacctttgactgtgataggaaaaatggtaccttcggttattatttggctgtattcgagccatataggggaaaaggatttgccaaagaaatgatcttgatggttcttcgctttttctttttggaacttgcttatcaaaaagtaaatacaactgtttattcttttaataatccatccatacgattacatgaaaaattaggtttcatgaaagagggacaactaagaaagatcattttcactaaaggtgcttattatgatggtttttgctttggaatgacaagagaagaatttgaactgaatcatggataatatcacttgtgcatcgataaagtactggattccaataaaataatggttttatccataaagcaaaagttttgcaaattatttcattggtttcatttaatgtgctataatcagaactgtaagacatttgattggttatagcgtattgctttaatgagaaatacataaaataaaaaagaccgaggtgctaccaacaccccggctatgtacaaaaagctgtccatcaaagggcttgctcgatgtggtttctaggtagacctatcccttcaggttctgaggctcaagggaggtctattttttatttatataagtcaacagggcaattataaacgacccgaatgcaagcattagcattaatacctggaatgttgacatagcatcaccccctttctttaggggatgagcaagactctcttgagtgagcaatcttaatgaacaggaaatattatactatacataaatccccttctcgttaaaaattcaatatattaacaacgtgaaaagaatttgcaaaatgcaggttcttttttgtattcagttattaaatcatttgagtgattgtcgatatttaacatgtgtaaaaatggaaaaggtgatacaattataaaaagttctgagaggattgtgattatcggtggtaaatgtaaactcaagcgatcttatttatgatccaaaattcttagcattttgcagcttggctacagaaggatatgggggaaataactcagctcctagtagatccattggttttagtgaattctgtgaaaaacttgagaaaaatgaagtagttaaacctgagaacaaaaaaagctcacttgacctaaataagtctttagattattggaaatcaaggtttaatccaggcggtaatctttcggcgttagattctcaggtattagatattatcaaaaaagcttacaacttaggcatggttaacaaagataatatgctgttgcgaaacgaagcagttaatgcgtataaaaattcaatttaaatatgagacagagcccagcttagtaaaagtgctgggcgttttatttattagagttatttgctttcaaatactctcgatgttctttctccaatttatcatctttgaatatataaatcttatatttttcctttgcttctctagacagattatcttttaaatactcacggagctttgcttcacttttggtttgatccatgccaattgtaattgccggatctgtttgaccaatttgcacactgaataaaccaaattcatcccgaatattatcaattacttccaaaggagactttttatttgcttcgattaaagtaatacccgacataatcaaagcaggaactaagaccaaaaatccgattagcctcttcttcattaactattacactctccttcatggaaaagaatccctcctttattaatactacgcaaatcatcattgacctttatattttattaccaacatttacatcgaacttttgttctggtttattttgaataaagaacacttgttctgttggtattagatcaataaaggagtgagtcgatatgcttagggatcgaggaacaatcaaatggacatcaatgatgcttccagaacatttaacacaacttaaacaagatttgattgatgtatcaaaaattgaaaaaccatccttagatgaccaacaaattgaagagatgtatcttctcgtctctgaggcgcttgaatttaataaagagttgaaattcaaactctttaacaatggattcgttaaaaatgtcaacggcagagtccattacattaattttgaacaacacaggcttcatgtaaaagaccagaatgacaatacaatttatatcaatatgaataacatcataggagttacatacaatgattgattactcacaatttccgcgtaagaatatactttgtgtcgatatgaaatccttttatgcttctgtatcggctgtctcaatggggctcaatcctttaacatgttaccttgctgttgtagggaatacggagagacagggaagtgtagtgttagctgcatctcctgcacttaaaaaagattttggaatcaaaacaggatcgaaactttttgagatacccgaaaatccaagaatacacattgtaaatccgcaaatgaagcttttcatcagagtttcaactgaaattacaaagctgttttacagatttgttcctgagaaatgcgtacatacattctctatcgatgaatcttttttagatgcaggaaaagaaaatcctgaagaaatggccaaagcaatacaaagcagcatgtggagagaatttggtttgatgtgtactgtaggcattggagataatatgttgctcagtaagcttgcgcttgacctggagagtaagaaaacaaagagtggcattgcacgttggagatatgaagatgtgccaaataaactctggatggttcgccctttgtctaaaatgtgggggataggagggaggatggaaagaaacctaaatcggatgggaatatcgactgtaggtcagttagccaaatttcctttagagctgcttgaaaagaagttcggaataatgggaaacaaattgtattatcacgctcatggaatagatttatctgaaataggagctctattaatgcaggggcagattagttttggtaagagtcagattttactgagggattacacaaggagagaagagattaaggctgttcttctggagatttgtgaggaagtagcaagaagggcacgcacacataataaagttggtcgaacgatcagccttggaattggttacagtaaagatgagcttggtggtggttttcatcgttccaaaacaattgatcttcccacaaatatcacgatggacatatatagatgttgcttgatgctctttaataagttttactcggggaagacggtgcgaagtatctcagttacgttaacgaatattgaggatgatgttaatcagcagttaagtttatttgaagtaaataatgaaaagagaaggagactcgggtttgtgatgaatggaattagaaacaaatacggatcgaaagcgattctaagagcagtttcttatacaccagcagggacagcacttcacagagctgggctaacaggagggcacaaatcatagcaaaaaagagatatcagactcattaagtttagatattataaaaaattctaaaaaatcaattaattggtattgaaaaagaaagaagaaatgttataattatgaaaaagggggtgtggtattctacataaatatgaaaaataattttcttaaatttattttatcttttaacttttcaactttatccgatactctgtatatagtagttgcaacaacttatatttatttcttaacagattcgttaacacttgcctctttgcctgtcgtacttgcaatgatagcctttagtggaggcagcttttttgttggatggtttttgtctttaacatcaaatttaaaaaaactatatttaataagcagtattataaagctagttcttctcttaatgttttttatagttctatatataaataacttaagtttatacttcttggtaattacattaattccattcactagtggcatcaatcaatccttaaattattcaattatcccgattgttgaagatgataatgttaaaggtaatagtactttaactattacaaggaatcttatcaatctaattgcatggtctagtggtggtatgttagtttccctacttaattataactacgtaacaatcatatctataattcttctattactctctattataatatttagcacccttgataaaaataaattataccttgccaattatcaaccaaaaaagcaaaagaaaaattcaaaaagtatactaaagctaattttgaaaaataaaaagttgaagatgctttttatttctgaagtgttttttcttttaggagggggaatttggacaagctctttcatacttgcatatgtaatcaatgttttacatcgaaatgaggtttggtggggttatttaacagcaacgtttttatgcggatcaatcattggcggattagttgtattaaggttaaataacttcttgaaaaaaaggttgcttttttccttattaatagcttctatattctattcagttgtggttttaggctatattttgaattctagcttttttattgctgcacttctgtttcttctgtttggtgtaccaaccaatttaaaagaagtggcacaagttactattatacaaaataatgctgggaatactgagaataaggtaaaattattttctttgtataatgtaatggatagtgttatacatgccggatccattgtaatactgggaagaattgctgatttgtatggtatagtttcatcgtttggactttcatttgttttatgttcggtaggcttgttgactatgttaatttactatccgaaaattaatttagatgaccacgaaaaatcaactacaaattatacaatttaggagtgatttaattgagaagtagaacaagtgaaatcataaaatcatcatatccaactgtgaatgatattaataaaatgtcgtatgtcgagtttttagcatttttaaaccaacctaatattccaccaggcggctttccttctattaaaaaagcagttgaacaatgtaattttgaaccaggttcactccttctagatgctggttgcaatactggttttgttacacatgaattggctcgtttaacagggagcaaagtgattggtttagatattagtcatgaaatgattagcactgctaaagaatatgcaaagttaaaagatatctcctacccaggactcacgacttttatgcaaggtgatgctacgaatttagttttccctgatgatttatttgatggagttttatgtggaggatcaactgcttttatggaaaatcctaaacaagcaattaaagaatatgctcgagtagttagaccatggggatacatagttgaaatagaattttattataaagaaaaaccgcagccagaacttttaaacagggttaacagtaccctaggtacaaatatgaaggccttcagcaaagcagattggattcaagcgtttgaagatcaggataaccttcaacaagtatatttctatgatggtgagttacaacatgccgacgaatcaacaattgaacaatatgtagaacaagaagtagagagttttgaaataccacaagaattaaagggtgtggttaaagataagtggcttgagttatatcaggtactatttgaaaatcggaaacttctaaattattgtattttgatatatagaaaagttactaaaggtgcttggtggtaataatatgacaaattgcgaaaaacctgtaattgattacaagaaaatatatattcttaaagagagtactatgataactaaaattactgagaactctttatgtatttgcaatagaggaagtgaggaagttgaaattgaaggagatccagatttaatattagacttttttgatttcttgaaaaaatcaatcccgcttaatattatttgtgcatttatgaatcgagatcataatatagatcaagaggattgcctagaggttgcgaaaatcttatatgaaaatagtttgcttgaaaaaaaagaaatttcggaagaaaattaccaacataaaaaaataaaaaaacgatatagtagacaacaaagctatttttcattgtttaataatgattatgatcaaagttttatacaaatgaagaatttaatgaaagctcatgtaacactaatcggaatgggagggattggatctccagttgcagatttactagttagagcgggtattaaaaatatacgttgtgtagatggagatattgtcgagttaagtaatttaaacagacaaactctctatagtgaaaaagacatcggtagattaaaggttgaggtcgcaaaggaaagactccaaacaattgataatgaagtaaaagttgaatgtgtaaacgaaacaattcattcggtagagcaagcaaaacaagtaattaataattctgattttgttgttgtgtctgctgacagtcctgtaggtaaactgcctatgtggattaatgaagcatgtgtatcaaaaaatgtccctgttatctttactggttactcaggcgatatcggcgtagttggaccattgattattccaagaaaaactctatgcttaaattgtgatgagcactttagcacaagagttgactcctcaatttcaaacaacgttagagaaaaagtaaattactttgataataaaataactcctccatcaattggtcccatttgtttcttagtctcttcaattgttgctcatgaaataattaaagcgcttgcgcaattaactataacacctatcactattaataaagttttaaatatcgatactcgtagccttaagattgatttccatgagattgaaaatgctaaaaatcagtgtacttgttacaaaataactacaaataattaacatgaaagggggtgaatgttaatgaaagttaaaaaaattaaaaagaagaaacctattaaaattggatttgatggtcccgtaatgaattaattctaagggcgagtctttataaggctcgctctcattattatttaaaaggatgtataaaaacaacattttaggaagtggttaatatgtcaattgaaattgaagatattaattatttatataatatattatatgaaataatgccacggagaacatctaatgaagtcttgtctatggattatttaactttctcagcgtacattggtgatcctaacgtagcgcccggaggatggaatactataaaaaaattagtcgataattcaaacattaattctaaatcaaatattttagatataggttcaaatactggacattcaagttttttgttgaagatgctcacagatgcaaaagtgacagggattgatatcagaaatgatcttgttgaaataagcaagaaaatctgtgattatgtggatctaaatgtggattttatttgtggtgatattaaggatatgccatttgaaaataaagaatttactcatataataactactggtacattggcatttttatcgaacgggcatcaaaaggcattagaagaaatgcatagagtactggtcaataatggggtggttattgacacatgtttatattataaaattaaaccgcctgaggatgttattaagagagcatctcaaaaacttgaatctgaactattgaattatgacttaaatcaatacaaagaattatatgaaagatgcggattcaaattatttaatcaggtttcaatgtcagaagactatagtgatgcagatattaacaaagttattgaccacatactttatagggaagaaatattatgcagagaagaaaatatgccaattggggaagattataaactagccttgaaaaacagattaacagaaacgttaacagtatttaaagaaaatgaaaattatttatctggagaaatactatttttccaaaaaaatgactaagcgagctgtttgctcgcttgattcatgttgtttttatcatactaaatacaactaaatcttgtgactttccgtttaaatattctgaattccgaagtactccttctttttcaaagcctaacgcaataggtatttgaatactttttgtgttttctggattacaccttatttctattctgttcaactttaatttgctaaaagcgtagtcaattaaaaattcaaggcaattggtaactattcccttgccctggctttgttcttctatccaataccctatacttgttttcctattgtcaaaatcaatttcatgtaaacttatcatcccaacaattttctcattgtataaaattcctaagttcaaactttctttctcaatatattcctttgcccaagatctaataatgccatcataaacagttttcttttgaacagaatctacccatggtagccatttcttcaaatagcttctgttattatcaactaatctaaataaagtatctctatcatctaaatctaacaactttaattttactttattattaacgttaacagtaaacatcttatcacctctgatcaagtgttgaattacatagggaaagttcatataaatttaaattgtaaaaggttcttataaaaacacaaagttagtgaacacacttacaagatggttttactgagcatgaagagtgaattttttgatctcactcttcatgcaattacactttaagtttcggctctttcagcaaccttatacgtatcgttttgttgttggagataggaagcacccactgttccggcaacaccgaataatagaactgtgcagataattagttttgttttcatattgcttctccccttttaatttgtcttctcgcttcatttgccaaacgataaaattcaactgcaccccaagcttctttttttgctgtgagaaaatcagctacaataactccatagctttccatatcagggtacatacctctttctctgaagaactggaatgcttctctcactaaatttaaatctgagtacaagaaaagacctttaaccattttcagcttttcaattactacttcattgttgtactgttctgctatctgctttgattgttcataaaacgcttgagaatttttagtatcgttttgccttccttttaagaaggagataacaaacaatgttttagctgcataatcatggttttctggctcaatgatttggagcgacttattaaagtaaaaaaatgctttatcaagttcttccatttgattataacataatccaatattaaacagtgctgaacgtatcaaatgtccacgattcttctcatttttattcagttcttctgcttcttggtaagctttatatgctctttttaacgcctcatcaaacttcatgctgtccagtaaattgccgaatatgacgaattgacaacgtactttttgtaccccgtatgtagagtttccatcgacatcaggttgttttttaaaaatattataagctctcatggcataattcattgaaaaataagtctgtttcatgtggtaatacacttctgacaatttaaaataaaattcagctttttccacttcaatttcttcgctatcgattgagtccaaatatttctctgcttgtctatagtgattaagagagaatgttaattctttttgtctaaaatagaacatgcccatgaaaaaataatagtaatattcgagcattccggttaagttttcatgaccttcatattcttttaactcaccataatttttctcaatgtcctttatggcgttagggtacatatacgatagcattaatttatgtctaaattcgagtagagagtagtatagcaagacatcttgattttcttccataatctttatttcttgcataacttcttttcgcatttcctcagctctaccgacccaattctttttaattgccacataccaatgattcatttttgtcgctactaagtcatagggaatgactttttcagtcttcaagtttcaaacccctttctgtcctttttattatatagttgcactggaggaaagaaatgtaaagggatttgtatgaaaattacaaataaattgattgtatgcgtgaaacttcaaaaaacgaaaaaaataccctcctcgattaagagaagggtaggggttttatctcggtgaatcataatccattgcttgttaactatcagaaataccttgagttgttgggtcaacaatgatacccattgcagttaaaaaagttagaagcgcattaaatttctcagtcaaattgtcaccaaatacagttaagtcatatatcgtacacgaataacatgcttatcgtaaaaatttataatgagctaaaaaagacagtaaacataaggatttttgatactttaattagtgaatagggggtaaacgatcgtaaaacataagcaggagtaggggaaaggggttgttttaaggagatattgatgagaaagggaaaattttaagaaggaaaaacgttgataatataggcttttacgatagcgattacgatgtgaaaaaggacgattttatgcgatattaggaaaatgtaaatttggggagggtgtggaaatagaggtgctatgggcacttttgttcttgtttttgagtatttggatgttaatataccccctatatattggtagttaaatccctatataatagctcttatacctgcatttcagttacatataatggttatgctcgaatgctttatggatgcatatataaaagtgaaaatcaagaatgtttttaaaaaaagcagaataatttctggcttgaaatgggatagataactctgtttttgatcgttatcgtaacaggaaaaattaatacgaacacttattatagccttaataagcaaaatgttctgagtgaagtactacatatattcaatcttgtctttttaatggaaatggagcatccatcgtttttttatttggccatattttgatcccttaatgatctcgactgattaatccttatatgcaatataagatttggccaagtaattgttattactcagcggtaacagaagagaaggaattagggaaagcatttgatttcatacataagagaccacaaggcaaagagttaagactctttaccatgaggtgttttccttaaccaattcgcaataagtttcattaaatttactgcaatagataccaaaacaatgatcaaagcgatctcaagtaagatgataagtccaatatttaagtcaagcctatcaaagtaatcaccgctaaaggaaatgagttgataaatacctagcattagagctataaagattgctcctaaaacaattagagattttttagagaaatccttagcatgttcaaaattataaattattagaaatacaaatagacaagccatagcaatctcatgagtcaacgaaccgcttgctgaaaatccttgcacaattaaggaagcaattaatccaattattccgattatttttttcaaggtatcaccttctttgtatgatcctaggtgccagattaccaattaaaggggaatttatcaagacatttactttaaagttaacttaaaatcgagattttaaacagataggaggaaatgaatgaatcaagatattcagtttttaaaagaacttcagcaagagttgaaatatcaagacagcgagggtcaagcttcaccgcgtttctggacggtgggtgactatgagtgggtggaagctcgcgaagaaaatgcagaacggtattctgtatacctgccagcgggtatgatacaacgtttgctgacaagtggctttcgaaagcttggtttctcggccagtgtcggcacgagcattaatcatattgtagccgatcttttcatctttagcccaaggagggataaggccccatctaagcttgcccagacggttattggatccatcgttaatgattgtcaggatgttttgtgaaggagcgacattatagtttgggtgatattcaccttcaggtaagaattgatctatgttgaattgcttgatgatgtcattgtacaagcttgatacacgaaaaacaaaaaggagggatgtgatgcagcaaacagttgaggttaaagaagttgaagtgttggtcaggggaatatggagaaagaataatcaatgatattaatacttaaacagtcttctgatagtctttacaataataagaaagcccccataccgggggcttgaagcggcctaataaccattaaatcccttgatttcaaagttttctgtatcgagatttaggctattcaattgctttaacaaaacctcaaattttaagcagtcaccgtttcttaattcttctggaatatcttcaggatttgcaattttcattccattctcaatccactgttttcggtataactgaattgcagcgtcaattaaataatctggagttacaataaaacctaagcttacgtcatgatcttcactgtagccgtattcaaaatcgcaacaagggcagatttcaaatgttttttgatactcaccatcattgtttaatgggttttcacttaatcctttatatccgcaaattaaacatgtatataatttagtcatagcaatccctctttaatatatttatagttcctattgatttttataataattataactaaaaatgttgggggggtgtgcaagcgggcaaaaaatgaccttttctcatgaagcttttattatattaaaactatattaaagaaactatgaagtggctagcatccgcaatggtcggaagagggaaaggaaaaaaggacattaagttttgaataaaacagcagtttaaagagaagggaggttaactaagcctgaagaaatattggataaccttcaattctcagaccgtggggaaggtcacgaaacttgtgtgtttactgtaatattgattttatccaggatataacagggaacattgaattataaatagaaaggagagattaaattttcctcaaaatagacattcgtccttttgttttattctgtttcttgattacggataccccttttactttgctataatacaactcaaaggttgtagatacaaattatcgatagtggtgtattaacagggggaatgaatatggtaaacaaagtattacgcaaaatagacggagcaacaatcttctttgtcttggttttaacttttgatctaactgttttcttattgtcttttgatgattattacttaagctttgttgtacaaacaaattatattttccctatactacttactttagccggtttttttgtgttagcttggaggtttaaaattcgacaattatatgtaacttgcataacaattccactgatactttcagttgcatggtttgcgttaactggtgattcatacgataccatttcttcgccaactaaaaatgtaacaataactatagaacataataatgccaccttaggggaaatgaatcatttttacgatttttatgttcatgttcctagtttataccctggtttaatgaaaaaagtgaataaggacaccatacgtattatgactcgaaatatcgaggataaagacgaccttagtgtattaggagtaggtaatgtcgaatggataaataacaaaataattttccattcagcatatgaaaaggcaattgaggttgatttacagtattagtctaagttgaagcaatcttttttgtgtaatatttgtataataaaggaaatcttgatactcttaaactttaaatatgataattctatatttaaattacatgcagcgtttactactaatttggatctttaaactgattatgatatccagatggatttgctcatgatgagtaaatcgatactcaaaacagctggctttaaaatttcttaatccaggatacatacattagagatgaagataacaactcagtttattgccgttattgctttggagaaactaagtaaatatttgtcataagaaattctgatctatatttggctcttatttgggaggaaagtatgtcaattttaacaataattgaaatcgtgttagtggcaactatattaggattatttgctttgacatttaaaaaagaaaaaaatgctgatgaagatgtgtttaattatgccagatatatgatttatttgcttgtagctgaagttgcaatgtttgtgatatttcaaataatttaagttgaaacatggattttaaagtgattttaaggaggcgtctagacaatgttgaagaagcttttaacatgaaaggggttataaacatgcaacttttaaggatctttattgttcatgtcttgtctgcgttatcagctgctgttgtttatgttttgggcattgattatgatggttatattccgtacttcttaataagtgttattctctttatcttctatttaatctttgctgcacctgttcaatatttcttgaatcgcaatccaaaaaggtttagcctgaactatttgcttacatacatattcttttcctttttagtgtggttaatctttgctataactactgacccaaaaaccacaatagactttctaatgggatatgaaatttacttatttagcatttcatttgctgtaatcttttggatctgggattcagtttttctgcaaaacaaggcaaagaaagcagctaagtaagaacgtcataaaatttcttccttattaagaaaaaagactgtcctttaattaccaatttatattatgattggaataaaagggggagagggaatgaaaaaattaatcgttctgactatgatttgccttggctttatgtcgagttttagtattccaaatgccgaggcaaagcttacattagagtacaaaaatgttaactttcacatgagtgaggattcagaaagtttttctatggcagattattttgatcgtgattatgaccgtacttggctattttacaaattcacaattcgcaatgctgaaggttgtactctaaatatgaaaatcagcagaattactcttgctggctgggtattcccacgtagtgagaaagaatttaccggaaattatttagattatactgctacagaccgagtagagggagatgctaatcgtaatcacgtgttagagattacaaagaatccaggttgtggagatgtttggataaacggtatttatggattcgaacatgaagagcctgatgagtattaaattcagcgaggccaaggagaaaaaagccttggccattattatttagttaatgatcattttaagtgatcagaaataactaagaggtgagaacgtgattaaatcaaatttaaagcccttattagacgaaaggaagatcagcatcaggcagctatccagagaaattaatcatgagtatccgactgtcagaaagctatacagagatgaaatggagcggtatccaagagagctgttagataaagtctgtacatatttaaacatcgagctgcatgagttattgattttccaaaaagtcagaaccatatcgaatactcaggatgaaaatggtatactaaagttataaggttaggaaagaattacaagttttctaggtctaaataaaatcgtacttttatccaaaagggtattttgttatttaaataaaatgatttgttgtttcataattgttatctaaaaggaaaaagattcgattaaccgaaagtgagaatgtgtgaatgaatttaatggggtatatggaggaaaggtttccaagactcgaattaattcctagcatctataatcagtggagcataggaatccatttctatctcgggggaaatatttaccaactcaaagagaatgaagaattgaatcttaagagatttcggtttgtatatgagcaaatctcaaccattttcaatcaattatttgaacaaaacgatgacatattccttgtgacgaatatgtataagcacaaaaccaatgacaaatttataaaaaaattgaaggtgtaccaaccgtttctaaagtgtaaaaattatttaaatcaaattcaagtaaagacatattcctacccgtttgagatagatgaagctgaagaatacgagatgcaacaattttccttgttatgcaaacctcgagacttacatgtagctgaactacttaaagcagccagtaatgaagattttccattgaaaccgagattcgggggttactctattgattaccctgatgttttctttgtgaacattacaaaagacattattttctttatctatgatgaccgaggatgtgaagtcatagctcttgatttcaaacgaatacgtccacttaatgaaaaatatcacaactgggtagaagaatataaatacatataaatacatataatactctttctaaaacgatttataccaggaaaggcagaattagattatgagggcactacatacaagatttaaacggttattgaaactaagaaacttagaattttttcagttggtcttaagtgatgatgagagatctgcatttttattagtagttgataaaagattagtggattttgattctcaaggcggaaaccatattagtgtttatttagttactcactttgagttatctgatcaatcatataaagatgtactaagctttaatgatgatcttttggatatgaagcataattgttcgtattcaatggatattctaagcgttaaagaggaatttgatttcgattttccatttgatatgcttgcaattaaaagatatgtacaagaattaataaatatgttagcgattaatctaactttacctgaaatgaaagaaagagattttgacaaactttctcaagactaaataaaactacgattttaaagagaagcagggggcaataatgttaaaaatgattactgtttggtataagtattacgatgataatgaccctaagttaaaccatattgaagacggctggtcaaagaatgagtacccaaaaccaattaaatcatcgtttgcaaatcaagaggcttggagaaaaagcgagtgggagagaaaatatgcatatcttgatgaaaaatctagagtagttgatgcgactaaggctatttggcttaagtaaagttttgtattaataaggttttttgaagacaggaggatagacttttgctacctaatagattgttaaacagttatgtttatactctaattatctctagtttatcatttggtttaatctttggtctgtatatgtttgcttactctggttttatggcattcgcattagtcactattggcatcataggagtttatgctttaatcacttacttggtatttgctgtccctttgcaagtgtggcttagaagaaggcccagaaaattcagtttgaacaattttttaatttatattgcagtagcctagctgtgtttttgttctggactgttgattatccgccaaatgctcttactgtattcagaagcttaaattattacattatgagtattgttgcaggtcttatttattggttttgggactccatattcctacgaaattaacacattaaattaaattatgaatttcacaccgtttacaacaagtaagaaggctgctgatccaaacagtaaatatccggacagtttttgtttgcttaatatcgcttcaactccgactaatgataaaagggcggcaacaaataattgcacaacaatcaacaataattcattttgattgaacaatgagtatacgcacaagactaatgcaatgcaagaaaccgaaatttttgcaacttttagcaaggtatcactccttatgcggtcatgaattaaccttaacacgattacgcgtcttaatccgagagcataaagaatcaagataaaagaagtgttttaaacaaaaagcgcattaaactaaatgctctttttcataccgcatcgccgacattcacgcaagaatattccactcttcacagagcttttgaacaaagtgtaatcacaattgtcgcagcggccatattttacatcaggatactctttgtaatcataaacgattgaagtgtcatatccattagtttcgtatttctcttccacaagatcacctacataatttattcacatactcaagaataccaaatttcgttcgatatagggagggaacaaatgattggattaggttattttttaataatctggcttggagttggattattgactggcattaagtttatttttgttgatcaggtctatgatgaagagtttaaagaactcatggataaagaaacagcagcgggcatggaaaggaatttggccagcctgtttttcaaagataagcttaatgttattgcttttttcatgttaattggtttgctgccattagtaatgaggattacaaaattatttaaaagaggttgatttatgcctttgcttgattatttttatgtactgcagtttgaaaacaaggaatacttcaaatcatttaagttagatgaggacggttatttaacatctagcgacctccacggcgcttctaaattgcaaacaatgtatgaagtcattgaggtagccagtgaactcaaaacaaagtgcaatgtgcaatgtgcaatgtgaggtaagggaaatccaagtcgtaaagcgttaggagtgttcaggtgtattggatagagtggattgaaaatggagaaaagaaaagcattgttgcagaaggttggattgaaggggctgttatacttgaagacttgtatcagaagcggtttgattatgttgaatggaagcggctttgaaaaggggtgaaatgcaattaaaaatttagttttattgtccagctttttaggaattgtgctatcaattatagggcaattatttggagtcctaacagatttctttattccaggtattgcaaggcttatgggggttttagctggcctcctagtattactttgcttgaagtccagaaacacagaaatgcagacatttatagtgagctcaagtactgcattaggaataataggtgcaggagttttatatcttccagcggctattgtcaatatcttaattgggttcaaactaaacaaaaagttaaaagaagaaaacaataataaaaagcagatctgaatagactgctttttgtttagtgtgaccgtggaaaattgtagtataatagtaataaaataatcattttatttagacattatttcttaaaggagtaagcttatggatttacttaattagacttacattatatctacaattataggagctgctgggttcattagtttattgtggttctcttattttaatgataaaggtgaaatataaagcagagcattgggttaatctgtatattgattatgatgatccaaagctaaaaagtaaggggggggattaatgatgacagaagacttttattgcggtgaagtattaagcggaaaaacaaaagtaaataaagttttagaaaccgagaatgtattggcgtatcatcatacaagacctttttggccggtgcatattgttgctattccttaaaaacatatctcttctttaatcactttggaagaagacgacaacgaacttttactcgagttgatgggtgtgattaaaaaggttgcagcgaaggtgacaaaagaaagtggttcttgcagggtgcttacaaacttaggagattatcaggactcaaagcatctgcattggcatatagcttcaggagatccattgagataaaagaatccttttatataaaatatacctaatgagtaaggtaaattacaatacaagaaacttttgatctcgtggcggaaaaatatggatacttatcaaaagatgctcgatgaagcaataatgaaaattttaaaagaagaggctgaagcaggaaaggaattagataaagaaaaactaaacaaaagaattattgatcttactaaagaggccccatcaagtatttctaaacatgtatatgaaagtttaaaagccgatatggctagaatgtattctgaagaagaagacattgcaaatgaatttaaatcacgtttacaccaacgttggtatgaaggatttttaatattacaaggtattattaaggtctgtgaagaaatatcaatagatttgcttgataagcattatgaaaaagagcatgttgatgaaaaaagcaaactgattttaagtgttctttttaaattgcattctaaaagtatacaagccggtaaagaagttttagttttgttaaaatcaggttattcagatggtgctatggctaggtggaggagtctacatgaattaaatgttattttcaaaaccttatcctataaatttaaggatatagaatttactcatgatttggtaagtagatttcttgattatagtgaaatagaaagaattaaagaaatctatacatataaaaaagcaactaatgttcttaatttaaatccaatttcacaagaagaagaaaaagaatataaagcaaaaaaagaaagtattttaaagaaatacggtaaagaatttgaaaaaccaaataattgggctagacctttgttttctaatataaataacaaacctctatatttttcagattttgaaaaactggtggggatagatcgattaactccctactataagcaagccaattatcaaattcacgctagcccaaaaggaatatttcaaagtctttctatggtatctactgtgaatcaacaatccttttatctttttggaggatcaaactatggtttatctttacctggacaacttacaggtatttcattaagtcagattactacaagtcttgttttattagaacctaaccttgatagtctagtcatagcaacaacattacaaaaaatggtagatgaatgcatttcaactcttaatgagatacaagaacaactaacaagagaagaaaatgaaaatttttaacaggttacaaataaaataattgttttattctgattaaattagtgggaagggtgttcactttggatcttatgtggataggaattggtttggctgcattgggatactttattagcgatggtttgaaaaacttcaaaaatcctaaaggaagttattcagactatccaactttaattaaggagtcggatcttcattatcaccttggtttaagtaaagcagaagtcaaagaattgctggaaaaattcccgggtgctccaaaattagaattaaaaggaacagtctattatccttaccagcaatttttgcagtggatgtcatcgattgattatacaaatagttaaagatttaaggagaattgtattatgactacagatcatttaaccaaagagagccttaagaatctggaaaaagaaaaagaggtatttaagataggtttctcgcctaactgttccatggttaattagtgcgatttcttaattgatgtaacctttggtcatacattttgaataacgaacccgaatactatctattgagctttcgtttctcaataaaataaaaaatctcaacaaaagttcaaaaattcccccgatttctggtggaaatgcattataatatgaaagcattactttaaaaatggtagtaatgaaccaggaggaagtcatggtaagcaagaagaacaaaattgtagcggcattattagcatttttcttcgggggtctgggaatacataagttttatttgggaagagtaggacaaggtattctatatattttgttttgctggactggtatcccgtctattatcgcatttattgaattcattatttttctttgtggaagcgaagaagcgtttgatcaaaagtacaatttttattacttccagcaacaatctaaagcttaattttaaagagggatacacagtccctctttagataaaataagtattttaaagaaatttattttgaattggaggctcggttacattcccagttaccctgattgtcaattcttatttttctttttcagagtccattcaaataacaatcttgcaacttctttgtaaaactgatctaagctatcaccctcaaatttttggtcaataattctaattgagcagttctttcttagtataaccttaattgttttcttcttcagtccttcatattcttcataaatttgcttcccttcattagacaagcggcagcaacaatgacttcacaatctctaatatatatctcctttatacgaaaagatccaatgggaattcattacagatattactccatctgaattagaaacaagaattgtgatcctacgaaaaaaggatcaggatatggtggaagaagaccacttataatgtgtttctaggtatttgtaattaaattacaaatacttttaatatttgctcatgaattcgtggtattatactgaaggggacgatcaaaagctttggcgttagtaattaaaaatgttttaaatgtatacgagtgctacctcaaagtcggaaaaaatattataggaggtaacatatgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaatttcgttgttggcaaaggttggactacaggttcgccatttaggacgataaactataatgccggagtttgggcgccgaatggcaatgggtatttgactttgtatggctggacgagatcgcccctcatagaatattatgtggtggattcatggggtacttataggcctaccggaacgtataaaggtactgtaaagagtgatggaggtacatatgacatatatacaactacacgttataacgcaccttccattgatggcgatcgcactacttttacgcagtactggagtgttcgtcagacgaagagaccaactggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtggtaacagatcatctttaattaggggtagctaacgggctgctgatcgttccttgagaagttttataatcaatgattattaaaatcgttagtaatggttaaaggttgttttctactaggtgaacggccttgcaattgctggaggtagggtattctccatctggttttataacttttcctataggttaatagaatggtatttaaatgagaatgctacaattttttgtagtcagcgcttgctcacaacagacacctttacataacccttctttatcaaacataagccttattcaaaataaaaatatctagtagttaaccaaatcctcataactttatactagttaaaggtgggactgttaagaacaaaaagtctaatttatgaatggggactctacgaacaaagcaagtaagttcaaaaagaacccaactttaggatttccttagaggattgaatcagctcaaaccaagttttttaatgcgactagctatggaaattaagaaaagaacctgggcaatttcaccaggttctttttatattgcacaaaaacagacacggtgatataatcacactacgtgcgctttctagttaaaaggttatagatatccatcttataattttattatatcctgctaggaagctcttgtcaatatttttttgaaggggagatgtagaatgagttctttggttctcggtttacatgaaattgaaaaaacacagctttcgctcgttggaggaaaagggttacatttaggggaattatcaaaaattcaaggtatacaagtaccagaaggattttgtgtcacaacagtaggatatcaaaaagccatcgaacaaaacgaaacgttacaagtgttgttggatcaattgaccatgctaaaagttgaggaccgagatcaagttggtaacatcagcagaaagattcggaaaatcattatggaagtagacatcccttccgatgttgtgaaagcagtgactcaatatctctcccagtttggcgaggaacatgcctatgccgtgcgttctagtgcgactgctgaagatttacctcatgcttcttttgccggtcaacaagacacctatttaaatattatcggcgtcgatgcaatcttgcagcatatcagtaaatgctgggcgtccctatttacggatcgcgcggttatttaccgtatgcaaaatggatttgaccacagccaagtctatttatccgttatcgttcaaaggatggttttccctcaggcttcggggattttatttaccgctgatccgattacctcaagccgaaaggtgttatccatcgatgccggttttggacttggtgaagcactggtttccggcttggtatctgccgattgctataaagtacaggatgggcaaatcatcgataagagaatagcaactaaaaaattggttatctacggacgaaaagaaggcggaacagaaacacagcagatcgattctgatcagcaaaaggctcaaacactgactgatgaacaaatttcacagctggcacgcattggaagagagatcgaagctcatttcggccagccgcaagatatcgaatggtgtttggctcgcgatactttttatattgtacagagtcgtccaatcactactttattccccatccctgaagcgagtgaccaagaaaatcatgtctatatttctgttggtcatcaacaaatgatgacggatcccataaaaccactgggattgtctttttttctgttgacgactgctgcacccatgcgtaaagccggtggaaggctatttgttgatgtcacacatcatctggcatcccctgacagcagagaagttttcttaaaaggcatggggcagcacgatcagctcttaaaagacgcacttatgaccataataaagcgacgagatttcataaagtcgataccaaatgataaaacagcaccaaatcccagcagaggcaaagcagatatgccggctcaagttgaaaacgatccgacaatcgtgtctgatttgattgagagcagtcaaacatcgatagaagagttaaaacaaaacatccaaacgaaatcaggatcagatttatttcgttttattctggaagatatccaggaattaaagaagattttatttaacccagaaagttcggttgtgattcgaactgctatgaatgcttcattatggattaacgaaaaaatgaacgagtggttaggtgaaaaaaacgcagcagatacgctttctcaatctgtaccccataatattacttccgaaatgggtcttgcgctattagacgtcgcagatgtgattcgtccttatccagaggtaattgattacttacaacatgtaaaagatgataactttttggatgaactggctaagtttgatggcggaagcaaaacccgagacgcgatctatgattatctcagcaaatacggaatgcgatgtaccggagaaattgatattacaagaactcgatggagtgaaaaaccaactacacttatcccaatgattcttaataatatcaataacagtgagccaaatgccagccatcggaaatttgagcaagggcgacaggaagctttgaagaaagagcaagagttattagatcgattaaagcaattaccggatggtgaacaaaaagccaaagaaacaaaacgaatgatagatatcatccgaaatttcagcgggtttagggaatatccaaaatacggcatgattaatcgatacttcgtttataagcaggctttactggaagaagccgaacgactcgtagaagcgggcgttattcaagaaaaagaagatatatactatctcacttttgaagaacttcacgaagtcgtacacacacataaactggattatcaaatcatcagtacacgacaagacgagtacaaattatatgaaaaactatctccaccacgtgttatcacgtctgatggtgaaatcgttacaggtgagtataaacgagaaaatctcccagccggagcgattgtaggtctacctgtttcctccggagtgatagaggggcgagcgcgtgtcattttaaacatggaagatgctgatttagaagatggagatatattagttacctcctttaccgatccaagctggacaccattgtttgtatccataaaaggcctagtcaccgaagttggggggctgatgacccatggagctgttatagcccgtgaatatggcttacctgcagttgttggcgttgaaaatgctgccaagctgataaaagatgggcaacgaattcgcgttcatggtacagaaggctacattgaaatcttataatgtctgatgtgtgtagagagccatcagatattccccaccagccctaactagaagttgggaggctgcaattgtaccgaatgataaagttcccgttgaactaacgaagatcgatagcacattaagaaaagctggaacctcttggaggaggtctggcttttctatataaaattggcgtagtgtgcaaaagccgcattttacgggcggcgcttctttaaagtgaattgtttattaccagcatttaaacttgtatttgtgcttaaaacaagagaaaaaggagctaaaatgctcctttataaatttaaacaacttttgtataaatagccgtgtaaaacccgattgagtaatcaaaataatgacgtgtaagcgtataagtataaccgttgtattctattgttggctggaagtccattggcagaggactaatgcggtatatagtgtcataatcatattcatcactttttactgcaacctcagacgaagtgccagcagccaatgcgggaaccgcggatattagcatgccaaaggataaagcagaactcaataagattttcttaatcttcaattacatcaactccatttacaatttatacatatattatgctgtgattggaagttgtttcgaaagtgaataatggatcgtaaaaagtaaaaaatctcgattttagcggaataagagtaagggtatgattcgaaggcaaccacatacaaacatttgagaaagaacaaaaagaagtagatccgtttggtgaatgtccctgttgtttattttaaagatcaaaaagagtttaaaatgggcggtattacattaatgacacgccacaatgttgctatttacgaagacaaagatcggaagaaaaaattggttcagatagttttatcattatagatagaggtggcccaaaagcagcctagaaataagcttaaacaaaaaatcctcccaaaaagggaggattactattacatattaactaaagtgtaagtcaatgaaacaatgaataaaaaatacgaaatataagatattgcttttgaagaacttgttttatgtttttggaatgtatagataagtgcaaaacccaagaagaaaactgttacaaaccaagaagtgtattgtggaaagagggcgaccgccaataccatgattgttgaaaaaataaatgaagagtaatgagttattttatgatcatcattcaatgaaatcacctctacgaatttttacccgatttagtctgtgtattaacagcttgtaaaagattcaatatgagaaaatgaagaagtttctggataggtttacactacagtttattgatatgtagttatggagtgagattgttaaacatgacgggagggagaaaggttgccgaaaattggagtaagcttgatagtgctcattatttttcttgcaggctgcaataaaaatgaacaaaacggtgacgaaacaaagatgcagagcctagtaggctatgtcgtgcttaaagacaatgaaagggcaattctcattaccgatacaaaagctccagtaaaagaagattacgatctttctgaaggacaacttatgaacaagtttaaaaataacatagtaattgtaggattaagtgagattgataacacagatgatctcaaaagaggtgaaaaaataaaagtgtggttccatacacttaaagagtcaaatccaccaagtgcaacgatacaaaaatatgaattattataaaaaaaattgttgaattctcatatagataacctctgagacaacaaatgttgttctattgcattgaaactgccagtgaccaatatcaagttcagttatgttaattcaagtggttgatatgttagtgtcttcgagacgaaatattggaagtgagtccggatattcatgagtattacaaattggtcacagaataagagacttaagggagttgtctgcattgtatgttcacttctttataatggcttgcactaaggagtatattcttggaaggaaagaaaacggattttagggtgcttaatcttaattcttgtcaggtcaaactttacttgttccataaaatgaaaacttgccgttaattataataacgtttaattttgtggtgtttaaatatatgattctagaggtcttatgaaagaaccgttcatcaaaaaatgaacggtaggagttaaaaaagtaatgtcttttcctttgtggcaaaaggctaaacatttatttgagatcgttaaggacgacttttgcagcctcagcgataagagcattatcataattagcatctttcgtaaagcggtttgacagaattgccacaacaataggagctctgtttggcggccaaacgatagcaatgtcgtttcgtgtcccgtaacttccggctccggatttatcgccgacttcccatcctattggagcgcctgcccgaatcagttcgtcaccagtagcattgcctcgcatccaatcggttaagatcgtgcgtttgtcagtcgtgagagtgttatctaaagtgaaggctttaagatcggttgccagtgcttttgcggtgctggtgtcacgaatatcaccaggaatcgcagagtttagatccgtctcgaatcgtttagctttcgttacatgatccccaatctgtttcagtgacttttcaaaacctttagggccgccaagctgttgcaacaagatgttcccagcggtattatcgctgtaacggatagccgcttccgagatttcttttaggctcatgcctgtatctaggtgtttctctgtgattggagaatatgtaacaagatcgtccttgctgtagtggatgacttcattaagtttttcaattgagtttttcttcaggacagcagctgcggctagaactttataggttgatgcgtaagcaaatcgttcattcggccgataggcgattgtcttgtttgaacctgtatcaattgcataaacaccaagcctggcatcaaattttttctcaagttgaacaaattttttattcgttatacagcttgccatgtttgtgtcttctatggattttgcttcggcatgtgttgagttgaaaaaaggtgtgaaaccagtaatgcttaaacataaaagcccaacacatattccgaattttattgacgctttatttttcaacttcatcaggcctcctcattcaaatgattttgtattacctttgaaatgtttcccatgacagttagtgtaacaaacccctttgcgctagtaaacatagaatcaatttatcttatatttttataagttgggagaacaaggacataagaatagaatcaacaaaaaagctgacaatggctgtcagcaaagtcatctattagaaagctttatcaattgtgattggagtgttattggatgcaaacgagaaaagtttatctctacgtatttcacacaatgtcagactgggaatatggatatttaattgcggaactaaactcagggagatactttaaacaagatgcagcatctttaaaagtagttacagtaggggttaataaagaaatgataactacgttgggaggattaagcataaaaccagatatttctcttgacgaatgtactcttgggagtcaagatcttatcattttacccggaggaaacacttggggagaagatattcatcagccgatcttgaaaaaagttggcgacgctttaaagctcggcacgactattgctgcaatttgtggggcaaccttgggcctcgcgaatgaaggatacttagattcgagaaagcacacaagcaatgacctagagtatatgaaaatggtctgccctaattacaaaggagaaacactatatgaaaaggaaccagcagtatctgataaaaatttggttactgcatcaggaattgctcctctggaatttgcagtagaagtattgaaaaaattagatgtatttgcaccagatacattgcgttcatggtataagctaaataagactcaaaagcctgaatatttctttgagctaatgaatacaataaatcgatagaaaacactttagcagttttttgtagtgctcctgaacttataggagcattttttatatgtgtctaggagctaaataaagaaatgcagaaacttttaaaaagaatatagattggtaagccttatttcgaatagagtttgatttgggttaaaactgttcttattaaggctcatttcatggtgctaaagattcatttggagaatactgtcttgatcagaaaagacccttccaatatattgaagtaaaagatatcgggaggaactcttttgaaaaagatgttgatgttagcttttacatttcttttggctttgactatccatgtaggggaagcttcggccgttatcgtgaaagatgaggagaaagtgagttttacaatgacagagaatgaaaaatggtttatgaagtctgataacctaaattcaaaccattggacatctcactttgggtacagattcaccattttcgatactgaaggatgtacaattaacgcaagaatcatgcgaatgactttgtcaggatatgaaataaccgttagtgaaaaaaacttctcgggggatcattttgattttagtgcaactgatcgagttgagacgatgccttataagactcattatttgattttgacaaaagatccagattgcggagatgttaaagtaaaaggtctatacggttttcagtttgatcagccagaatggtaataaaaaagaatctggattctcaccagcctaaacgccagccaagctaatgtctcacatgcagacattagctttttccattgttttataggctgtcgtcaggattctagaagactttctcgtaatagtcgtcacatgtcacatgaagcccaaatgacaggggaaatgtatatcattcacactttccgtcgtgaaaatgtaaatgtattcataaaaatcccgcagcatatcagcagtgcgccgaggataatgttgatagtgatctgttcgtgcaattgcagccatccaaagaatagggccaatacgggaacaaacattaatgccatggatgcttttgacgcttggatttgattgagcacccaaaaccatacgacaaaggtaaagccggtggaaagcaagccattaaacagcaatgaccacaccgcctgatatgtccactcggctgaagggaccgcctcaaatataaaggaaaacaccaataacatgacggctcccatcataaggtgccaggcattcatgtgaataatatcgatatgcttgaattgtagcttgctgaacacattcgcgattccccagctaagcgctgccgcaagtacgcacagctccccaaataaagcgctttgatcgatattgagcatttcctttccaaatataaataacagtccgaagaggccgcagaccagtcccatcgttttatacacattcattttctcgtttaatgaaaaatggctgatcaccgtaacaaatataggcattgtatataccaaaacagaggttttccctgaatcgacaaactgcattccatacgtcaaaatccccatatagcccagccccatcaacaggctcatgatgatatagcttttgagatgttctttttgaattgaaagcttttttctttggatgaagagaatgagaaataaaggaactgctccgatgaacaggcgcaaacccgaaaataaaagcggggggatgtcatgaattcctactttcatcgcaacccaagtataaccccaaataagtgtgacagatatgattcccagcataacttttaccataatgaagccgcctttcttgttaaaatatcgtgctggtttctatcatatgttacatttatgtataactgaaatacatttttattattgggggtataaccaaatggttatgaacatgaaccatcttcacatatttgtaaaagtcggggagaaattaaatattacagaagcggcaaaagaattgttcatctctcagccggcggtaagtaaagcgataaaaaacctggagagctcactgcagctcaaattattgatcagggataaacatcatggtttaatgctgactgacatcggaaaagaaatattgctgctggcgaggcaaatgaagggaattgaaagcaaaatatatcaagtagccaaccgggaaaacaagctgttaaacgggaaggtgaaaattggttcatttcctgcagtttcaacaaatatcatgccacaggcgattgcggcattcagatcaaactacccgctgatccgcatagaattgatcgaaggaacctctgaccaaataaaaggatgggttgaagatcggacggttgatatcgggatcgcagcatctccatttgaaccgtttgaaaatcagctattgtgtaacgactatatggtggccgtcatcccgccgcagcgtgacgaattaaaacttgaaaagcatgtcgaccttgaaacatatcaagatgacctcattttttgtaaaggcggtcatgaaatcgcgatgtcaaacgcattttcacaatacaacatcgaattaaaggaaaacttaactgtgcaaaatgccgaaaccttgattaatatggtcaaaaataacttgggtatcggcatcatttcaaactttacactttcatccgtcccgcatcaattgattaaaaaggacatctttcctagggttacacgcgatattggcgtcatcgcacattcatttgaagagataacgccggcggcgcatgagtttgtcaaagtgttgaaagcagttgtaatctgaatcagttatcgtgttgcgatgaaatttgaagaagatgaatactcaccggcagagttacataaaagaaaaaagcaaccatttgaacgttgcttttcactctatttgggaccttgtatgcgtatgctaagaaaaagattcatccatctctgcctttgtgggactctgctccttaacttgttttaatgatgctactataagaaagctaacaatcactagcaagagccatgaacttacctttccaaggtgtacgagactccatgtatcgatttggtttggatatttccaagctccaaaaaacgtagcgatattttccgctatccatataaaaaatccgatgagtacaaaagaaagtgcgagcggcatacggtaacgagctccattcacctcgtatgtaacccatgtttgccaaaagacaatgatcacaagccctgataaccaccatcgaatgtctatagaaaaatggtgggtgaaaaaattcaaataaatcgctgcggcaagcggaacaactgcaaaaaaagacggccacttaaccagttcaaccttaagccttctccatgcctggcacaaataactggctacacttgcgtacataaagccgctatacaaaggtactccaaatattttggagtatccttcttctggataagaccaggagcccatatggactttaaaaagttccagagcaagcccaataaggtggaataatgtgatcacttttaattcatcccgtgtttcaagaccggaacgcaccatccacaattgcatgagaacgcagataatgagcagccagtcatatcgcggcaagaagggcagtgggatgatttgcgtaatagccaaagaggcaaaaataacggcaggaaacaaacatgaaagggcttgttcccagccaaaaagaacgatttgttttattgctctcatgatgtatgcctcctccatagttgtgttcttcgtgtatggaagggacgcttagtatagcagctagatggatataagtttatgtccataagctcaccgccaatcactttatttttctgttgatcttacatattttttacgaatcctgtgtgtcttcatcacttcggtattccaatatatccccgggctgacattctaaagccttgcaaatcgcttctaaagttgataatcgaatagcctttgcttttccgtttttcaatatcgaaagattagccatggtgatgccaactctctctgaaagctctgttacgctcattttcctcttagcaagcatcacatcaatgttgataataatcgccatgtcatcacctcagaccgttaagtcattttctgattttatatctatcgcttcttttaacagtttttgaagaacagcagcaaagaccgcaatcaccattgaagcaaaaataataaccaatccgatcacaatgatacccggggcgtcgtctatctcggccatcagataaaagacaggcatgcctgctgcgtaaaagatactgatagtgactgcgcagtattttatattcttcaaagctcttacagacaaacccgagaaagctttgtttttgtcaatatagcttaaaagtttgaacgcttgataaagagcaaagtaaaaaggtatcgccgttacatacaaatagatgaaaacgagatattttatataagcgatatttggaaataattctgctgaatagttggctatcttaggcactaaaaaaatgcataaagcaagaattggaattccaataagaaccaaagctatctttaaaaaaattgtcgacattcgattcataacaagcacctcatttatttgttgtctaattgaatgtaacaaaaaaattatcgtttctcaataaaaaaatattgatatggattgatttgttgttgttataggagacccttttcatttttgacaagacaaaaaagcatccctcatcactgggagatgctgaactacttcaaacttgccgactgaatgaaccgtttgcctcagtgagctcagggatcggtgtgaacataaagctaagctcttttatgaaggtttttatcaacgtctaaagattcaaacaaacgatgggaagaaatacatcaaaggataagcggctgttcatactaatgatcgggaggtaaaccgacttatgatacaaattttgatcactggtctttttttattggctcagccgagtgagccgcaggacagtttaacggtcacacagcaaggacggacgattgccactgttaaccgtgaagactttacaatgcctcttcccggcactccaatggttgactatgaaaaatacagtaaattcatcaaacagcttgatcagaaagtgtaccgtgagccgataaatgctgtccttaacgatcatggaagcatcgtcccgggcagggttggctacaaactgtatcaacaggcgtttatggaaaagttttatgcgtatttttatgggcaaggtccctccaagatagaagtgccggaaatgaacatttatccgaaagttgacagcgagctgctagctcacatcagtacgcagcagcttggtcagtacgtgacgtattttaactcaagcaataaaagccgttcacacaatatttctctttctgcaaaagcaatcgacaatcatgttgttttccctaatgagacgttttcgtttaaccaagttgtgggaatgagaactcggaacaaaggatataaaagtgcacccattattgtaaaaggggagttgtctgaaggtgtaggaggaggaatttgtcaggtgtcctcaactctatttaatgccgttgatcgtgcaggactgcagatcgttcagcgctattctcatactagaagtgtaccatatgtaccgcccggacgggatgcgacggtaagctggggaggtcctgactttcgctttcaaaaccaatataaccaaccaatcttaattcgggcaaaaaggtatgggggaagtatgattattacgctatactcttctgatgtgataaacagcaaattgagaaaaatccccaaggctccatctcggataccgaaagaaataaatgcagagcagtaaaagacaaaacctcaggtaaggttttggttaagagagcttgtagattgctcaaaatcaattctttaaggagcagccagtgaaaggaaggagggataaatgaagtgaaaagggtattattttctgtaattgtttttacagcagttggatttacgttttgccaatcaaaagcgcatgccctgacttttacggtgttgcctattacacaaaaaacagaccagtggtcagtaaaagtaagtgaagcaaaaaatgtaaaggaatttgcgagacctcaaaaaggagaatatcaagtatattccttggaagtcaaaaatataggggaaaaagcagctacagtggatgtgcaattgtatagaaatgaccctgattcaatcacaaggttttcactttttggatgtcccgatgaaaattgtgtcaaaccaaaagaagattctaaaatgttagctgaaagtttaaatgatggctcaccgctgaagttcaatcattttatgctggcagataaagcctctgaattagaagttgttataatttggacacagaaggggcaagaagggcgcaatttaaaacagacctttaaattcactgaagatggcgttaattagacagtaaagatagaatggctttgatgattcgatctcttactttgcctgaggaaaaaacgaaaataattgttggataaccatcgtagctgagtcaaatgtcaaagtgactgtgatttatgactatagagaagaaccagaggaggctttttggatacacttatccgatgggagtgaaatgtttgtcgatgatcacaaagtctttatggaatacgaatagagactttgtgactgactgcgcatttcaacttaacattttactgataatgtaagtgacacctaaataagtgcaatccgtttcatcattaaaaaccgctaatttcaaaattttctatgtcaagatttagttttttcaattgtttcaacaaaacttcaaattttaagcaattgccatttttcaattcttctggaatatcttccggatgagcaattaccatcccgctctcaatccattgtttacgatacaattgaaatgcagcctcaattaaatgatcaggagttacaataaaacctaacctcacatcatgatcctcactgtagccaaattcaaaaccgcaacatggacaaatgtcaaacgttttttgatactcgcctttatacaaaggattttgaattaatcctttgtatccgcaaattaaacaagaataacatttttccaccaagtttaattccccttttatcacttatttactattgctgtcccgtaacaaatattacttcaaatataaacttcgtgtactgtatttatagcataagcagtgcatctaatcctcaaagatgaacacactttggatttgaaatgggtgatataggaatcaagataatatctgaataaaagaagggttttacagttaattggcaaaatggaaaagaaaaagtatttaagttggaacgggtatttattctattaggcatgtaaagtgtgccagcgaaagttgaattccatgaaattatgttaaagggggaaaagaggagatgtgctacattgaaatcacaaaggacaatattgaagacaatcatatttgctgtgcattaggcgcgaaacaatatgagcatgcagttaatgaaaagaagagatggctcaaagctcgaatggatgaaggattggtgttctatcgcttacatgaacgggcaaaagtctttattgaatatctacctgcgaatgaggcatgggtgcctgtcaatgcgcctaattttatgtacattaattgtctgtgggtgtctggcagatataaaaataacggtcatgcgaaacgattgttggacaaatgtatagcagatgcgaaagcgtgcggcatggatggcattatccatatcgcaggcaagaaaaaactgccctatttaagtgataagcatttctttgagcatatggggtttactctacaagatgaagctgccccttattttcaattaatggctttgacttggaatggccttgcagcttctcctgcatttaagagccaggtgaaaagtgattctatcaatgaaaaggggattacgatatactatacagctcagtgtccgtttgcagtgggcatgataaatgatttgcgggaattgactgaaaagaaaggggttcaatttcagtcaattcagttatcatcgaaagaagaggcacaaaagtcaccagctatttggacaacttttagcgttttttttgatgggagatttgtgactcacgagatcatgagtgtaaataaatttgaaaagttacttaatacactagcttgatttttaataataaaaatccattttaaggttcttgactcaatgaaacaaaaaatgcatttaagagctgttatacgttttaatcttgtctttagagagcactttaatttaagtcaaaagtttagacagtcatctgttagatcattagcccttttttattttcttttcggtaacattttgatcatattttcctactaaaaagttaggaaagtggggaaaaacatgagaaaaaagaacaatattaagaaatggctattgatcattgctggattcttgatcatctgcatcaccacattatttgtaatggtgtcaggaaacgaagtgaaatatgagggcagcgggaaaagcggactgtggatgtctaaccttgaaaaatcagacaaaacttcaattggacccaattattttctaaatctatattggcaggggagtaagaaggaagaaaagaggactgttgttgaaagaattactctgtatgtagatggcaaaaagtatcaagatgataacgtagatgagtacgacttatcagagtacacaggtgatgaaatgccgggtgggggacgcatggaggaccatattgccacctttgattatatgcctgaagatgaagtgataggacatgatgtattagtaaaagtggagtggaggacaggccagaaaagacagacagaagaaatcaaattacataagaagctatggtataaaaaatagcttatttgatgtatttgtgatcacattggtggtcacttttttatttgcggattcctaggcacagcaatctaagattctgcataggctgaaataaaatcttgttcatttctaaaacgaggtgcatgctgttggaacaacaaccaatcaatcatgaagacagaaacgtgccgcagcctattcgaagtgatggagctggagctattgatgcaggcccgcgaaatatgatgcgggatattcaaaatccgaatatacttgttccgcctgttacagatgagggtatgattcctaacttgagattttcattctcagacgctcccatgaaattagatcatggcggctggtcaagagaaatcactgtaagacagcttccgatttcgactgcgattgcaggtgtaaacatgagcttaactgcgggaggtgtccgtgagcttcattggcataagcaagcggagtgggcttatatgcttttgggacgggcacgtatcaccgctgttgaccaagacggacgaaatttcattgctgatgttggtcccggcgacctttggtacttcccggcaggaattccacattccatacagggattagaacactgcgaatttctgctcgttttcgatgatggaaacttttctgagttctcaactttatccatttctgattggcttgcgcacacaccaaaagatgttctctctgcgaattttggtgtcccggagagtgctttcaactctcttccttcagagcaagtctatatttaccaagggaatgtgccgggatcagtcgacagtgaagacattcagtcaccatatggaaaagtccccatgacctttaaacacgagctgttaaatcaacccccaattcaaatgccaggggggagtgtacgaattgtggattcttctaacttcccaatttcaaaaacgatagccgctgcacttgttcagattgagcctggcgcgatgagagagcttcattggcatcccaatagcgatgagtggcaatattatctaacaggacagggacgaatgacggtatttatcggaaatgggactgcccgcacatttgattatagagcaggcgacgttggatacgtgccttctaatgctggccactatatacaaaatactggtacagaaacattatggtttttagaaatgttcaaaagtaaccgctatgcagatgtgtcactcaatcagtggatggcattgacgcctaaagaattagtgcaaagcaacttgaatgctggatcagtcatgcttgattctctgcgtaagaagaaagtgcctgttgtgaaatatcccggtacgtaaagactgaaccgatcacacagtggtcttaaagtaactagagctgggtgttggcctgtgttttatcaaatccctatatatatgttatgtagggtttttctgcttgaatcgtattgtaatgagctttaaaatgttaatgtagaaatgataaccattcgataatgggaattcaatggccgatttctaccagtttgattggctttaaaggaggagaagaaatgaaagcactcatatttttatccagtttgactgccattgggagctctatattggggcgatggttagggatgctggatgattcttatgctgttggcgatgcttggtttataggtgttttagctggattgatttcacttctaatattgattgatagtcaaacgatgacaaagaattacatagtaagtttaagtacgatactaggcattcttggagtgggatttatatatttcccagctgcattcatcaacatattattaagtagtacactggataaacaaaagaaagaagacctccatgtaagatgaaagaaatttcatttaattcttaggagggaaagtgtatggatttacctctatgggcttatatcatatttacaatcacaggtgcggcaggtttcataagtttaatgtggttcagtttttttgctgacaaaatagaaaagtgaagcgattttataaaaatgtaaactattttatatgaaagggataacattgcttatttaagtttacataataaaattatttcaaactgatatcgaaaataactaattgatctatgtactaaatattcataattactaaagggattggcacctaaggacaaagctatttgacaagttcttgctagagaatttcaatcactacatatgattttctgcatcaagaagctcagctgaattatttttaggtgaatttactaatgatgaaacctggtatgcttccatgtcatcagcatcataaggtagcagcaaactttgcagataatcagggcttgtattttgggggttaagccactccttttcatgatcatgggccaatataaccggcattcggtcgtgtatatctttcatgaactcattaggctcagttgttatgatggtgcaggtataaagagggtatccttgatgtgtgctccacttttcatataagccagcaaacgcaaaaagagcagatgatttcaatttgatccgcattgggattttggttttggaatcaagccgtttccattcataaaaactgtctgctggtatgatgcagcgtttgctgacaagcggtcttcgaaaggccggtttctcggtaattgtttcggctcgagcattgatcattttataaccgatcttttcatcttttgcccaaggtggaataagtccccatctaagcttgcctaagcgattatttgatccatcattgatgattgcaaggatgttttgtgatggtgcgacattatagcttggctggtattcacctttaggaaaaaattgatcgatgtcaaactggtcaataatatcatcaaatgcagagtacaaagtaaacctgccgcacatatccatcatcctttttaggggtttttgaatagtttgtgggacgaacgttcatttaatacaggttcagaacaatgatttctttttacttgcgataaactggtataataagaaagccatttaagaagttatgtagaaaaaaacatatgctttttagtttgaccgacgctggatcttgaaggagttacaaggatcgcttaaaaatagcctataagtataaaatgaggcacagcgtttttaacgcagggcctcttttatatcagtagccaaataccagagttgtactttgtgatccggcatatttcgtgacaaattcttttgtatattccggcgtttggacacgatagctatagtttgacccgggattccaagaagtcagcggagaggtttgcttgttgagtgatggatagctgcctatgtctttgaaataaccagtgcccttgtcgtcaaggatgccgcctttttcactgcctttcccaaagtaattatattcggaatatatttttgcttttgtagcaattgtaatcgcctggttaaaattattgctgtaattgtttttaacatgaaagtaaccgtatctcatcagacctgggcctctaacatacaagttctcaaaataattattggcgattgtcatgtgggggtagccgtcatattgatgctgagaatcatccgggtatcctaaaatcaaaccgtatttatgattcgcaaattttgagttgctgatcgtgatataatctgcggattttccgatatacacgagtttgtccaaatcggttccgcttgcattatagctatgacctgagaatgtgacatgatcaatccaatagttcataccggaatctaaataaagctggatatcattatttccgttaatctgcggactgtgttcaaacgttaaattttgaaaaatgacatttccagaagctgatgaagttgttaaataaatatttttcagcgtttttttcgcgtaagagcccacgagtgttttatttgagccaatggtaactgttgttttcgcagatgcggaaagatcattttgaagcactaaaattttcggagtggatcctcctagatgggtttttaaatcatttacgctttgaatgtaaacaatctgcccgttttttccacccgttgtgcccgttttagagatgcctttttcatttttggcatttccggcaaaacctaaaaggccatttgttgaggtattcggaaaatcgactgcacctaatgcttttccaggcaagagaaccaaaaacaagctaaagacggtgaaccataaacaaagtcgtttcatcacaatatgcttcctttcaattttaatcatttccttgcggggattattattacagttaatggaaaggaatgataggttctatcttcctaattaatgttgggttacttaaaaaatagagattgcgccaaaagacatactaacaattgaaatagaagaaaggattgatacaccgttgactgcagcagcttatcgaaacaccttgctatcacttttatgtttaacagctggaatcgtggatgtaatcgggtatttaagcctgggacatgtgttcacagctaatatgactggaaacattgtattattggggttagctatcggaaaatccattcaggtcactgtttttaattccttgactgcgctaatcggatttatatgcggcgtgatcattgctacattgatggtcggaaaggcggaaaataccctttggccttctgctgtgacaaaagccctcgcacttgaagcattcattttgtttgtctttgcttgtctttctttttaccgggcatttgttcctgtgcacattctaattatactcatgagcatttctatggggattcaaactacagcagcaaaaaaactggggattgcaggtatttcttcaactgtgttgaccggcactttggcttctcttttagaggatatatccggccgtttgttttttaagaagcaaaagaagactttcttaagagatactgtgttaagagcactggctattattttgtattgtgtaggggctattattgttgctctggctgagcctgatttttatcacttcattatttgggttccgattgtgctgatctttggcatcatgatgacagctaagttgaaactgagcggggaaaaatagcttttcctgtatagctgctatcaggccaacagcctgtttcatttcgttattgaaatgcgaattttgagagggaaaaataagacattcggctgaagtgcacattcgttcatttgtattggctttttcataagtacctacatttgatatatgaatgatagtgaatttgccttaaaatcatctatgaatctatttcctctttcaaaccagatggattgagtcttataatgataatgattctcatttaaagtctggtttgaggaggaccaaatatgaaaaagatcatgagtgcatttgttggtatggttttgttgacgatcttctgtttttccccgcaagcttcggcagcatatgacgacctgcatgaaggttatgcaacgtatacagggtcaggttattcaggaggagctttcctgctggatcccattccttccgatatggagattactgcaataaatccggcggatctcaattacggaggagtaaaagcggcacttgccggctcttatttggaagttgaagggccaaaagggaaaacaaccgtatatgttactgatctttatcccgaaggcgctcggggagctcttgatctgtcacctaatgccttccgtaaaatcggcaatatgaaagacggaaaaatcaatattaaatggcgtgttgtcaaagccccaatcaccggcaatttcacgtaccggatcaaagaaggcagcagcaggtggtgggcagcaatccaagtcagaaatcacaagtatcctgttatgaaaatggaatatgaaaaggatggtaagtggatcaacatggagaaaatggactataaccattttgtgagtacgaatttaggtacaggctctctcaaagtcagaatgactgacatccgcggaaaagttgtgaaagacaccattccaaagctgcctgaaagcggaacgtccaaagcctatacagtaccgggccatgttcagtttcctgaataaaaaatacgaaacagcggatcttttcccgctgttttttcaatgttctgtatctgcatgtaaaaatgttttaatcatgttcaactgctcctgctttggataactggtatacagcctgcttgaaatccgaataggatctccgaaaaaatatctttcgtagtgagtttgtctagttccgaatgaactcattgttaaatcccatgccaaacggaaaattttcacacgttcttcagcatttgtattggttgcttgaagatattggtcaagatcttcccgtatctctgagtcaaatgcattttcggtaggcagtgtcaccattccgctagctccaattaattgtatgatttcagtgaatcgaggatatagcttagggatgatcgtactgatgacttgaagaggaattaaacaggggcgcatatagccgaattcatctaactgagcatcattttccgatttgtcaatgagcgctttgattgtttccaatcccacaatgatttctgagagcttttcttggatgtgctgatattcggaaacattaatggtgtcgacaagaagctgtgcaacacctaatagaaattcaatttttatcatttgcctaatgacaacctggtgaaaggtaaaggcatgaaaagagctttttgtcataaaatctttagctacttccacattatcgtaaaaaaacacacgattccacggcactaacacatgatcaaaaaccacaattgaatccatttcttcatacctggagcttaagggatgattaaaggaagagtcgcttaatacaaatgattctcttgtgatgaattttacgccttttgtattagaagggattgaaaaagcataagcttcatctgtttcaaagaaaaatttaggcgctgaaaaaaccaagatttcatcggtcaacccgccttgtgttgcaagcagtcgtgcgccatggatcattaaacctttttcagttctatcaatgactttagcagatatcggtttttcacttagcccaaaataggactgtgaccggttcacttgcggagtaatgaatgtatgggtaaaagaaaggtcatgcttagcagcttgttcatacatatctagtatatgttcaggaaagcaattctctttatcttttagaagctccgctgacgaagcaaagctcatcataaccgtattcatgtaatccggacttctccccatcattccatgagtatgtctagcccaatgttcaatcatggtccttctttttttcaaatcattttttgttttaggctggagataggaaaggccgattcgattatgatctccaggaaggcaataagtcatttcatgtattaactcatcctttgtttgcaattcataaagtgagctttttgttttgattattcctttaaatgcaggatgctcagaaatgttaccctttattttttcgccatcataccatatttcgttttctagtttattcaatcggtcaatgaattctttaccattgatgatccccatttaagtttcgctccttcatattatgctgcgtattgtattatattttcgagaaaacagccggttcagccaatttgaggtgggaaaagccttttttagaaaaacgaataagagtgacttacataccgcaaaagactgcaaattttacttaaggtttttctgtaagttcagagacgtaaagaattgcttattcatatgagaatatcactataaaacttgataacccgtgtcgatattatggacatgggcgtaagcgaattggatttaaacgcgcttgaacatattttatttcagccattacattgtgcggaaagggaaaacgacacatgaaagtgaaaacaaaattgctggggattatatcaatattagttgtttcaattattggaattggaggctcctcagtatttatgatttcttctactgtgaaaaagaatgaagaacttaaagacaaaatggaattccaaaaagagataaaacacatccaatatgaattgaccgggttatcaaatgatgaaagaggcttcttgattaccggagacaaagaatacgacgagggtatgaaggaaaaagcagacgatgtcttaaagagtcttgaccgggttaatgacttgattgatgaagagagatatcaatcaaatatcgaagacattaagacaagttttactcagtatagagctttgaatcagcaagtagtaacagcctactcttcaaatccgaaaaaagcagaaaccatccattttggagaagaaagaacactaagaaaagaaggcgtagatccggctgtcaataagctgtctgatcgcctggatcaagaggtggaggatctaaaagatgaaatacgaggcaatgggaaaatgagtcaatggctcatcatcattgtcaccgggatatcagttatattaggcgttgttttaagcattatgctgttaaagtccataatggtgcccctaagaagcataaataagcagctggaggaaattgcacacggcgacgctgatttaaccaaaaaagtcattgtgaaaaataaagatgaatttggccagcttgcccaatcttttaattcttttactcattcattaactcaaattgtgaagcagatcagcagctcatctgaacaagtcgccgcttcctctgaagaattatcggcaagcgcggaagaatcgaaatcaacatctgaacatatttcacgagccatgcagatggctgccgaaagcaatgtgaagcaaagctcgatgacagaaaagagtgcggaatccattactgaattattagacagtatatcatcagtcgcttcaaatacagggaacatagcggatctttcttcttcgatgagagacaaagctgagataggctctaagtccgtcaacaagatgttagatcagatgaaattcattgataaatctgtagattcagccggcaatggattgcaaacattggtatcgagcacagcagaaatcagcgatatctcttcgcttatcacgacgatttcagagcagacaaatttgttggcactaaatgcagcgatcgaggcggccagagccggagagcaaggaaaaggatttgccgtggtggctgaagaagttcggaagttggcggatgaaacaaataaatcagcaaaccacatccaatcggtggtagcgaccatccaaaacgaatcgatagaaacggtaaataatattaaagttgttcaagaaaatgtgagctcaggtattgttctttctcaagagacaacaggaaatttcaatgaaatactgaacctggtggaacaggtcacttctcaaatacaagaagttgcagcagcaactcaacagcttacttcaggcgttgaagtgattcagcacacagttcatacattggctgctggtacaaaagaaacgtcagcaaatacagaagcggttgcaaaatcatcagaggaacagctacattcaatggaggaaatctcctatgccgcagaatctctatctcagttggcagaagagcttcaaaccgtcattaatcgttttaaatattaaacaggctacttacgtgcaacccccatcttattcggtgggggtttgctactttactgtggttgtttttacaaacagagctaactgacttcttttaagttagctccgtttgtatggctagtccaaattttgatcgattgtcccttcaaaatagtcatcgctgacctgttcatgagtttcagccaatcctttttctaattgcgtgcttcctttataatctgagggctcaaagtatttcccggcaacatttgttgtgtcatttttgttttctttgttatgagtttgtgtttcagtgtttacactttctgtctcagtattgctgcttatagattgctgaaaatcatattccttgtctaatgaagaaaatcttttataatcatcaggtctgtctgcaccgtttttttgagtcactttacttcctccagattattgatattttagtgggggtaagaacttatttcgttcttttaggatcagaaccatgttttttaggatcatctgctttaaaagctgtttcagtctcatggtcatttctcatttgttcaatacttgaattttgaattccctttttactcattggtttcactcctttacgaaaagtgttgaatatcaactcttcttattttgtctgttgatcaggtattcatgcacttttttcattcgcgctttggccaatcaggagaggcattttcatgccagtcgtattatttaataaaaagtcgtatttttgaaaccttttatcatcgcattgttaatacaaaggttgtgaatttatactaacagcactgtgaataaatcaaacaaggggggtgaaaaaatgaaaagaatcgcatcatattatttaatgacattagggctatccagccttacatttggtttgtttttagggttttattctttcgttatgtatggcgatatgataattgcattgtttacggcagcaattgctttattatacggttttgtggtgtatggcctttttgctgttccgctccaaatgaagttgcagaaaaaagcgagaacattcaatgtcatgtacctattgatttacagtgtggttgctttcatcgcagctttcctgttttttgttatcaatgaacctgcgtcaatagcatggacattgcaatcgtacttttattatatgttaagtattgcggctgcagtgatttactggttatgggattctctgatcctttataaacatacagcttccggtgtataggctaaattttaccaaccggagatatatggaggtttaataaaaattcagggtattgcactaacattgctgcgtgaatcaaaaagctttaggtttcatattttttaaataagatcctccgcggataaaggcgcagtatggggacataatgagagcacacattcaaaccgaataggttttctaagtgttttacgatacatacgttcatcaagaacatcacgtcatcaaaggaatataaaaactattgttgtgaaacgggcatcttgagttgtttgaggaaagaacatagatggtggtttatcgttttatcagcgcttatagaacaaagttttggtggcggtcaatccatacagctaaacagaggagagcgtcgtgacaatgaatctcgctctcctcagatttgttttattcaccctgatgtttttcaactaatgtgaatgtccaatcttttaacatatgtttctggacatatttttttccgtttatttcgatgtaaggcaggtctgccatgtctccagctaactgttttgcttcagtcgttgttattcctaaaaaaagtccaatgtaaaagtaaatatcccgttcttttattaggaagatatcattttgttcattacctttggtttggttcctctgctttaagccttcaccgataaaatatccagccaaagcaataccaattcctaaaaaaacgtccatgtgtatgcctccattatgtcgatgttatgttatacgggcttggcatactccgggtttcattatttttcaaaccttttcaatctgtacacggcctgaaaaaaaggtggcgccgccgcccatatcggacaagcgatctggggttagcgcgtttacaagctgtttttttccttgttcatccgcccataatccttggctgacaacgacacctggcagcacttgttctccaactgcagcggtcagctcgcattctccccggctgttccaaattcgtacaggtgccccatcaacgattccgtgtttttcagcatcttttgtgttgataaagagctttggcgtcttctcaagcttgatgtgtttttcattattggaaaatgttgagtttaagaaattatggtttggccccggaacatacataaacggatgttcattatcggttacaagaggtgtatatgtcggtaaagccgggaagccgtcttgtttcattttttctgaatataattctatttttccgcttggcgttggaagttcgcccggaaacagcggcttttcgcgttttgctttcataaatgaatgcttagtgagtgcatcgtaatcaatctctgccaaatgcggattatctggatggtcaagcgcctggcggattaattcttcatctgaatctttaagctcctgatctgtgaatcccattgcttcagccagtaatcggaaaacctcagtgttagacttgctttccccatatctctcaatcaccggctgctgaagctgaatgtaatggtgccagtaggaggtgtaaaaatcagtattttcaaaagcggatgttgcaggcagtacaatgtccgcatatgcagccgtttccgttaaaaacaaatcatgaaccacagtaaacaagtcttcccgcagcaagccctgtctgactttgtttgcttcgggcgcgacgacggcagggttcgttccgtaaataaatagagagcgaataggcgggtctgtttccaaaagcaccttgccaagctgattcatattaaatgacctcggggtgcgccctttcaataagtcgggccgttgcaaggcatttgtgttatattctaaaattccgctgttatgcttaattgcgccgccccctgtgtgcaaccattggccggtgatcgccggaagacaggcaatcgtccttacaatcatccccccgttatcgtgatgctggggtccgtttccgattctgataaaagaaggggaggtttccccgtacatttttgccagtcggtaaatatcttcggtactgacaccggtgatcgtcgataccttttcaggatcatattgtttcacgtgttcacggagctcttcatagccaaccgtgtactcggacagaaatgcttcatcatgaaggttttctttaaataaaatgtgcatgatgccaagagcaagtgcactgtcggttcccggttttattgggataaaccaatctgcaagacgtcctgtttgatttttatgcacatcgatcacgacaattttggcacctttttttcgcgctttttgggcgatcgtaatttggtgcatatttgtgctgaccgcgttgattccccaaaaaataaatagttttgtatgaacggtttcctcaggatcgattcccgcgcttatgcccattgtatatttatagccttcagatcccgctttgctgcaaatcgtccgttcaagctggcttgaccccatgcggtaaaaaaagcggcggtccattccttcagctgtcaatttccccatatttccgtaaaagctgtaaggaagtatgctttcagctccctctgcatcaatcagctgtttccagcgggaggtgatcgtatcgattgcctcttcccaagaaatcggttcaaatatcgcttggcctttcgcacctgttcgtttgagcggtgtagtcagccgctttttatcatatatgcgctccgtcatattccggactttgttgcatatgtttccggctgtgacaggatgatcagggtctccttgcacttttacgattttcccgtcttttttatgtattaacaatccgcactgatccgggcagtccagcgagcaaacggatttgaaaatgccgttttgttgtgtggcaaaagatttcatggcccagttcctctctctagttagatattttgtaagaattataacatttcggatcataacgtcaattctgaaaaaaagagattgacatcaatctgagacttctttatgataaacgtattctttattctgaaaattacatactcaacattttctatccagagaggtggagggactggccctatgaaacctcggcaacattattgtgccaattccagcaagcgtcagcttgaaagataggaaagcaaggtttataccggcgtctgcctgtaacagagcgcgcctatatatgaatctctttccatcttcggaaagagattttttttatgaaaaatacgatgaaaaggatgttttgcaccatgacggttttggttacagcaccgtacaacgaagaaggacgaaaagagctagaaaacttgtttggctcagttgcttatcaatcttggaaggaacaaggccgggcatatcgggaggatgaactcattcagctgctaaaagcaacaaattcgacaggcttgattactgaacttgatcaggtaacaggcagcgtatttgcttctgttcccgaactttcatttgtcggtgtttgcaggggaatgccctccaatgtggatgtggcagctgcctcaaaaagaggcatacctgttttttatacaccagggcggaatgcacaagccgttgctgaaatgtttattggaaatgtgatttcctttctgcgccataccagcgtctcgaatcaatggctgaaggatggaaagtggaacagtgattacctgcaggcatatgtcaaatttaaaggaaatgaattaacaggaaaaacggttggcatgattgggttcggggcggttggccaaaggattgcaaaactgctgactgcgtttgactgtaaaataaagtattacgatccattcattcaagacgatcatccgctgtatgaaaaagtatctcttaaaacggtgttttcagacagtgatatcgtttctgtccatctgcctcgtactgaggaaacacttggacttattgatcggaagtattttgatctgatgaaacagagtgcgattttcgtcaatacttcaagagcagttgttgtaaaccgtgaagatcttttatctgtattaaaagaacataaaatcagaggtgcgatattagacgttttttatcatgaacctccagaggaatcagattatgaattgatttcattgcctaatgttctggcaacaccgcatctcgctggagcaacatttgaagtggaggatcatcacgtgacgatactgaataaagccctcaaaaagtggaagggtgaaaaaactcttaatattccgacaatgtataacaaggacgaactgaaaacaggggtataagaaaggaggctaacagaatgaaaaaacaaaaaggctatcttgtttttgatattggcacaggcaatgcgagggtagcggtcgtgagtgtaaccggcagtgttttaacagttgaacgggaggacatcgtgtattccacagagacgctttacccggacagccgttatttttctcctcaggtgatgtggaagcaggtgatgaatttggcaaaacgtgcgctatcccgttcgtgtgatattgacatcattggtttgacatcgacgagccaaagacaggggattgttttgattgatcaaaacggcaatccttttctcgggctgccgaacatcgataatcgcggccgagagtgggaggcgggcattcccgatcgggaagagatatacagccgcacaggccgcctgccaaccgcacttttttctgcgctcaagctttatggattaaaacagcgccagccctctttatgggaaaagactgcaagctttacaagcatcagtgattgggtgacgtaccaactgagcggaagattaacatatgaaccatcacaggcaacagaaaccctgctgtttgatgtgaagcaaaacacttggtcagaagagatgtgcgacatattcggcttttctccatctatccttccgcctcttgtaagagcgggaacagcaattggaacgatagcaaatgaatatgcatccgaattaggcctttcaataaatgctaaggttatagcagggggcggggatacacagctggctgtcaaaagcaccggagctggacttgaggacattgtcattgtatcagggacaacaacgccaataaccaaaattactgaggatcatggcgacacaaaacataaagcctggctgaactgtcatgcagatcaagggcattggcttgtggaaacgaatccgggaattaccggattgaattatcaaaaattaaaacagattttttatccgaatgaaacgtacgaagtaatggaggaggagatttctgcacttgcaaaagaagaccatgcatgtgtagcggctctcggctcttatttatcggctgaaaagaatgcattaacgagaggcggttttctttttgatgccccgctgtcagcacatttaaagagggcacattttgtacgtgcagcgctagaagagatcgcattttcaatcaaatggaactttgacattttaacagaggttactccgtttgaacgtgactatgtttgggtgtgcggagggggattccaaagtaaagcgctcactcaatatatcgcggatcttcttcaaaaaaaggtctatgtccaagagggatatcatcaggcatctgtggttggtgctgcagtcatttgcaatgaaacctttcaattaacggaggagatgtcagcaaatgtccgggtgatcgaaccgaaggactgtcagacagaattggctttatatgagaaatggaagcaaacacagcgctttttttcaggttcagaaagcaaagtattaatttaaggcggcatttctgctgttttgaggaatcatttaattttcaactttaataaggtaatacggtaatgaataatagcatctaaggaggagacagatatgttggataaaataggaataccgaagcggcttgcctggggatttttaggggttgttttgtttatgatgggagatggccttgaacaaggctggctcagtccttttttgatcgaaaacgggctcaccgttcagcagtccgcttccatttttagtatatacggaattgcgcttgccatagcttcctggttttcgggtgtatgtctcgaagcatttggcgcaaaacgaacgatgtttatggggctgttgttttatgtgatcggtacagctgcttttatcgtatttggatttgaacagctgaacctgccagtgatgtatgtgacttacttcgtaaaagggttaggttacccgctttttgcttattctttcttgacatgggtcatttacagaacaccgcaaagcaaactgagcactgctgtcggctggttttggattgcatattgcctcggcatgtttgtgttcggcgcttggtactcaagctacgcgatcaaagcgttcggttatttgaatacgctttggagctctattttctgggtatgtctcggtgcattctttgcattgtttatcaataaagaccgttttgaaaagaagaaaagaaaaagatcagaaacagccgaggagcttttaaaaggggttacgattctatttacaaatccgcgcgtgcttacaggcggaatcatcagaatcatcaacagcattggtacatatggttttccagtctttttgccgatgcacatggcccagcatggaatttcaaccaatgtgtggctgcaaatttggggaacgattttcctggggaacattgtgtttaaccttatcttcggtattgtcggcgataaattcggctggaaaaatactgttatttggttcggcggagtcggctgcggcattttcaccgtcttattatactacgcacctgttttctccggcggaagtttagcggttgtcagcgtgatcggctttatttggggcggtttgctggcaggctatgtgccgattggtgcaattgtgccgacggtggcaggaaaagataaaggggcagccatgtctgtattgaatttagctgcaggtttatcagcgtttgtcggccctgcactcgcttggctgttcatcggtctcgtcggcgcgcaaggtgtcgtctggatctttgcggccctttaccttgcaagtgcggtcttgacaaaatgtattcatatacctgaggaaaaagcagttaaggaggaaacatctcctcaatatgcatcttaattagaaagcgccctgtttgagggtcgctttttatctttttaaaggaaaagggatgtggcacagaccaagagaataccgtcattctcttggtttcacaatagagtacacatttgtatcatttggagtcccattttgatacatgtactgtcttaaaacgccttctttttgaaatcccatttttataagcagtcgatttgatgctttattttggataaatacaactgcgccaatacgcgtcaggccaagggaagtaaacccgtaggagacagcctctgaaatggcttctgatgcaaagccgtttcgccaatgcgctgggatgatttcataaccgatctctgcacgcctatgcttttgggccagagcgtgaaagcctattgttccgatcagttctttagtgtcccgtctttcaattccccaccgtataccgcgtttttcttgatagagggcagcaaacgtttgaatcattgaaatggcctgttctatagattccaggttttcaagtccgtaatagcgtgtcacctcatggtttgagaaacaagcaaaaatggcttccgcgtcctgatctgtcatttgtctaagtgtaagccgctccgtttctaaaacaggaaacattcaaccactccccacgtttgtttctgtttatcatatcccttttatttcctcttttctatagaaaattcaaaactgaggaagcaaaagaatgaatttgtctttctagttgctctttgtttttggcgaattgttttaaacgatggccgtttgcgcctgatgggtggggaaagccgctaaggcaaatcaaattctggagtctgtactgtctgatcaaggtttcacatactgtttcggcggcttttcctaacggaataagaagagctggccccaccacatgattgagctccgcagggaagtgatcaaaagcataggtgcttaggataggagagcgagtgatggccggtttgtatccggtatagtttttttgctggataaagacaggatatttaataacggaagttgtatggagcatatgccgtaagtcaccaaaaagctgcgcggcgctttgaatgccgaaagcctgtggcagcccgcataaatccagcatggtaataaggttatgtctcatcgatccggagaaacccgctgctatttttgtgtctactaccatttgctcaagagtcccgccttgccgcaggctttcggcggctgtttcgtacgctgtcttcatctgggaaaaaccaggcgtgatcccggcaatcacaagcgaggcatcccgattgataaattcattatgaggtgaatagtagatgccaagttcgttttcttgatggagacgaaatggatcagtaagtaaatcggactttgtaagtgaagagggaagagaatgtagtttttctgcgaactcttttaagcagctgcggtttataatcatgtgtaagcctcctcgaaaaatgagatcccatttgtccattctgatcgtaacaacgggatctcattcatccttatctgctattaaaatgtcctgcctgccacacctctttgactgcttggggaacttctttcacttcagctgctgtctgctgaaacgcgtattttttcatttggacatcatgctgaatcttcttttgtttttgcgtcagcagctctgcttctgtttttaatccctcgatttgtttttgcatagcctgcgtaacagaagtgagctcctttagtgcggggtctatttttttcttgttttggatcacattaaaccctaaaaatatgatagaaatagccaatactgccaggctgatataaacaataaccatatgttcactccttttttcttttgtcattaccctgtttccgcttttttaatccaaagaaatgatgattgcacagttcgtttgatttgcgtattggatttattctacttataatgtgatatcgtacataggtaaacaaagaaagggtgcttcaattgcaaagtttacaaaataaaaccgctttaatcacaggcggaggcagagggatcggccgtgctacagctcttgctcttgcgaaagaaggcgtaaatattgggttaatcggccggactgccgcaaatgttgaaaaagtggcagaagaagtcaaagcgcttggtgtaaaagctgcatttgctgctgcagatgtaaaagatgccgagcaggttaaccaagccgtcgctcaagtgaaagaacagcttggtgatatcgatattctcattaataacgcgggaatcagcaaatttggcggtttcttagatctgtcagccgatgaatgggaaaatattatacaagtcaacctaatgggtgtgtatcatgtgactcgcgcggtgcttccggaaatgatcgaacgcaaagccggagatatcattaatatttcgtctacagcgggccaaagaggagctgctgtaacaagtgcttatagcgcttctaaatttgccgttctagggttaacagagtctcttatgcaagaagtgagaaaacataatatcagagtcagcgcgttaacgccgagcactgtcgctagtgatatgtctatcgaattgaacttgacagacggtaatcctgaaaaagtgatgcagcctgaggatcttgctgaatacatggtggcacaattgaaattagatcctcgtattttcatcaaaacagcgggattatggtcaacaaatccgtaaaaatgaaaacctgtctttcgacaggtttttttatttgtttatttgagtgaaatccgtaccggtaaaatgagatatgtaaaccctggcaatcgtttaaattgaagatagcagtgaatgcaggctataatagaactaagaaaactatgtaccaaatgttcagtcgaaatttattttttccgctacacctataatcagtaaacatgaaatgactggactatcagtctttaatataaaaaaggaaaacaataaaagaaaattgaatatttagtacatagtgttgtcagtgacagaagaaggagtgcatatgatgaaagaagaaaaaaggagttcaacaggctttttagtgaaacagcgcgcatttttgaagctttatatgataacgatgacagagcaagagagactctatgggttaaagctgcttgaagtacttcggtctgaatttaaagagattggttttaaaccaaatcatacagaagtataccggtctttgcatgagcttcttgatgacgggatactaaaacaaattaaagtaaaaaaagaaggggctaagctccaggaagtcgtcctctatcaatttaaagattacgaagccgccaagctatataaaaaacagctgaaggtagagctggatcgctgtaaaaaactgattgaaaaagccctctcagataatttttaatagaaacaaacacccggcgcagcagtgtcaaccgggtgttttctgcttttcattatacatatttgtcgaaaagaaacaatacaaatcaatgatgaccttcaaacttgacatcatttcctcacgtggtaacattttaaacgtgtgaaaatgcgaacaaaaaagcgaacaaaggagatgttaccgatctttgatcaaaagaaagtagcctttataggagcaggatctatggcggaaggaatgatatcaggtatcgttcgtgccaacaaaatcccgaaacaaaacatctgcgttacaaaccgcagcaatacagagcgattaactgaacttgaacttcaatatggcattaaaggcgccttgccgaaccaactatgtatcgaagacatggatgtgctcattttggcaatgaagccaaaagacgccgaaaacgctctgtcatcactaaaatcacgtattcaaccccatcaattaatattgtcggtccttgccggcataactacctcttttattgaacaatcattgcttaatgaacagccggttgtcagagtgatgcccaacacttccagtatgattggcgcttctgcaacagctattgcccttggcaaatatgtgtcggaagacctgaagaagctggccgaagcattgctcggatgcatgggcgaagtctatacaatccaagaaaatcaaatggatatattcaccggaattgcaggcagcggacccgcgtatttttattatttaatggaattcattgaaaagacaggcgaggaagcgggcctcgataaacagttatctcgaagcatcggcgcacagacacttttaggtgccgcaaaaatgctcatggaaacaggagaacatcctgagatcttaagagataatatcacgtcaccgaacggaacgacagcagcggggctgcaagccttgaaaaagagcggcggcggagaagcgatttctcaagcaataaagcatgctgctaagcgttcaaaggaaatcagcgaagatatcgaaaaaactgcagcgccgctatcaggagtgataaagtgacgcctgatacaagcatgaaaagagtcgttgtgaagattggaagcagttcattaacaagccttcatggagaaatcagcattcgtaaattagaagcgctggtcgaccaggtcgtcaaactcaaagacgccggttatgaagtgattttggtttcctcaggcgcagtggcggcgggatatcggaagctcggatttatccaaaggcccgagaagcttccagaaaaacaagcatcagcttcaatcggccagggattgctgatggaggcttattcaaagctgtttttggcacacggctatgtcgcatcccaaattttaattacgagaagcgatttttctgatgaatatcgatacaacaatgtcaggaatacaatgaatgtactgctcgagcgcggcatcatcccgatcataaacgaaaatgacacagttaccgtcaatcggctcaagtttggcgacaatgatacgctcgcagcaaaagtcgcaggattgattgatgcagatatgcttgtgattttatcagatatcgacggattatatgacggcaatccgcgcacaaatccagaagcgaaaaggatacagcgggtgagtgaaataacacctgacatcgaagcatgcgcaggtgacactggaagcatcgttggcaccggcggcatgcgctctaagcttgatgcgtttaaaatcgtaatggcgtctggcattaaaggtttcctaggtcaggcagatgtcggcgatattttatatcacgccgttcatgaacaggcggaaggcacctattttgaagcagaaggaacgcttccgttgaatcaaaaggagcaatggatcgcttttaattccggtccggaaggtgaaatgattttatcagatgattgttcacgaaaaataacaaacggccaatcgagtttatacctagacggtgtacagaagattaaagggaaatttaaaagcggttcagttgttcggctaatggattcaaaagggacggaaatcggccttggaatcgtcaattactcttctgtacagcttcaagaaccggaaaagaacaaggaactgacaaacagagctctaattgatcaagaagcatttgtttgccatgtggatttttctttacctgtaaattaatttgcagaaaaaaacccgaagcttctatatagaagctcgggttcattttttttattgatactgctccagcttagagaaaaattgaatgacaaactcataaaaatcattcgcggaaggcgcaagctctctatttttcggtttaatgattccgacagtccgttttacttgagggaactcaattggaattttcacagtaaaacgaggtgttgtttcagcaaaagtactttcaggcagaagggtaacgcccattcctgcggacactaaccctttgatagcatccaaatcctcaccctccgtggaaacgagaggagcaaagcctgcttgtttgcaagtatcgattgccatctctctaagtacaaatccttccgggaacaatacaaattggtcgttgcgcaaatcgattaaatgaaccgttttttgtttagcaagcggatgatttaatggaacaagcgcgtaaattttttcagtaaataatatttttcccgttatgtcagagaaattcgtcggcaccggtcctaataaggcaagatcaatatcgcggtttctgacagcttcaatcagaaacttataggagccttggcgcagcaaaaattcgacgtgcggatattcttctttaaacgctgaaatgacagtcggcaaaagctggctggcgaggcttgtaggaaagccgatctttaccgttccgcgatgcgggtcaagatactcatcaatttgctctttcgcataatcaatggctttcatcgccgttttcacatgaatcaaaaattcttttccgattggcgtgagtttgatatttctcccttcacgctcaaataaggtcacatttaattcttcttcaagattggcaatttgtctgctgattgctgattgggccacatgcaaatgatcagcggcttctgaaacgtgttctctttcagccacctccatgaaataacgcagttggcgcagctccatgtttgtctcacatccatctatctcattttgagattcttttgatctaaattatatattgtttatatcgttttgaaaacctacaatgattatagagttgttagattttatgaccggtattatcggaaattgatcgggggagagaaattatgacgtacaatcaaatgccaaaagctcaaggtctctaccgtcctgaatttgaacatgatgcatgcggaatcggcctatatgcacacttaaagggcaagcagactcacgccattgtcaaacaaggacttaagatgctttgccagctagaccatagaggagggcaaggcagtgatccggatacaggagacggagccggcttactggttcaaatccctgatgctttctttagaaaagagtgcaaagacatcaatctgccagaaaaagaacgttacggggtaggaatggtctttttctcacagaaagaagatgaaagaaaaaaaattgaaaagcaaatcaatgcactgattgaacaagaaggccaagtcgttcttggatggagaactgtacctgtaaatgtcggaaaaatcggaacagtggcgcaaaaaagctgtccgtttgtccgtcaggtatttatcggcgcaaattctgatctaaaggacaatttatcttttgaacgaaaattgtatgtcattcgtaaacaggctgaaaattggggagtaacggaaggtcttgatttttattttgccagtctttcaagccagaccattgtttacaaaggccttttaacacctgaacaggttgatgcattttattcggatctgcaagacgaagcattcgtttctgcttttgcgcttgttcattcacgcttcagtaccaatacattccctacatgggaaagagcgcatcctaaccgctatttggttcacaacggtgaaattaacacccttcgcggaaatatcaactggatgagagcacgtgagcagcaatttgtttctgaaagcttcggtgaggacttaaacaagattttgccgattctcaatgctgacggcagtgactcttccattttggataacgcatttgagttttttgtgatggctggacgcaaaccggcacatacggcaatgatgctcattccagagccttggacggaaaatacgcatatgtccaaggaaaaaagggcgttctacgagtaccatagctccctgatggagccttgggacggaccgacagccatttcatttactgacggtaaacaaatcggggcgatccttgaccggaatggtctccgtccggcccgttattatgtcacaaaagatgattatattattttctcatctgaagtaggcgttattgaagttgaacaggagaacgttttatataaaaaccgccttgagcctgggaaaatgcttttaatcgacctggaagaaggccgtattatctccgatgaggaagtcaaaacacaaattgcaactgagtatccgtaccaaaaatggcttgaagaagagcttgtacaagtaaatcctgatccggagtcaagagaagaagaacaatttagtgatcttcttactcgccagaaggcattcggatacacatatgaggatatccaaaagtatctaattcctgttattaaagaaggcaaagatccccttggttcaatggggaatgacgctccgcttgctgtactatctgaccgagcgcaatcactgtttaactactttaaacagctgtttgcacaagtaacgaacccgccaatcgacgcgattcgtgagcagcttgtcacttcaacgatgacttggctcggtgcggaaggcgatcttcttcatccaagtgaacgaaatgttcgccggattaaactgtatacacctgttttatccaatgaacagttttacgcattgaaaacgattgttcatccagatttaaaaagccaaaaaattgatgtgctgttttcagaggatcttgaacgcggattaaaggacatgttcacacaagcagagaaagccatcagccaaggcgtaagtttgttaattttatcagacaaaaagatgaacgaacgactgacaccaattccgccgcttctggcagtaagcgcgctgcaccagcacttaatccgcaaagggctgcgtacgaaggtcagcattattgtggaatcgggagaagcacgtgaagtgcatcactttgcagcgttaatcggttatggcgcagatgcgattaacccttatctcgcttatgcgacctacaagcaggaaattgatgaaggccgtttggatatcagctatgaagaagcggtcagcaaatatggaaaaagcattactgagggcgtcgtaaaagtgatgtccaagatgggaatttcaactgtgcaaagctacagaggcgcccaaatctttgaagcggtaggaatcagccgcgatgtgatcgaccgctatttcacaggtactgcatcacagctaggcggcatcgatttacaaacaattgcagaagaggcacagcgccgccaccgggaagcgtatcaggatgattacagcaaaacgcttgaaccgggaagtgacttccaatggagaaatggcggagagcatcatgcctttaatccgaaaacgattcatactttgcaatgggcgtgccgcagaaatgattacagtctgtttaaacagtatacaaaagcggctgatgaagaacgcatcggatttttgcggaacttgttcgcatttgacggaaaccgcaagcctttgaagttggaggaggttgaatccgctgaatcgattgtcaaacgttttaaaacgggtgcgatgtcattcgggtccttgagtaaggaagcgcacgaagctttagcaatcgcaatgaaccgtcttggaggaaaaagcaacagcggtgaaggcggagaagatcccaaacgctttgttccagatgagaacggcgatgatagaagaagtgcgatcaaacaaattgcatccggacggtttggtgtcaaaagccattacctcgtcaatgctgatgagctgcagattaaaatggctcaaggtgctaagccgggtgaaggcggtcagcttcctggcaacaaggtatatccatgggttgccgatgtccgcgggtcaacgccaggtgtcggattaatctcacctccgccacaccatgacatttattcgattgaggatttagcccagctgatccacgatttgaaaaatgccaaccgtgacgcaagaatcagcgtaaagctggtgtcaaaagcaggtgtaggaacaatcgctgcaggtgttgccaaagcgactgcagatgtcattgtgatcagcggctatgacggaggtacaggcgcttctccgaaaaccagtattaaacatacagggcttccgtgggagcttggccttgcagaagcacatcaaacactaatgctgaacggacttcgtgaccgtgttgtattagaaacagacggaaagctcatgacgggccgcgacgttgtgatggctgccttgctcggcgccgaagaatttggtttcgcaacggctccgttagttgtactcggctgtgtcatgatgcgtgcctgccatttggatacatgccctgtcggtgtagcgacacaaaacccagagcttcgcaaaaagttcatgggggatcctgaccatattgtgaactatatgctgttcattgctgaagaggttcgtgagtacatggctacgttaggcttcaagacatttgatgaaatgatcggccgcactgatgtacttcatgtaagtgaacgggcgaaggggcactggaaagcaagccagcttgatttgtctacacttctttatcagcctgaaggggtgcggacgttccgatcgccgcaaaatcataaaattgatcaatcgcttgatatcacaacaattctcccggctgtacaagaagccatcgaatctggaaaagaagctgatatttcgattgaaatcaataatacaaatcgtgtagccggaacgataaccggcagtgaaatctcaaagcgttacggagaagaaggtcttcctgaagatacaatcaagctgcactttaccggatcagccggccaaagctttggagctttcgttcctaaagggatgacgctttatttggacggagactcaaatgattacgtcggaaaagggctttctggcggaaaaatcatcgtcaagtcaccagaaggattcaactctgcttcggatgacaatgtcattatcggcaacgtggctttttacggtgcgacaagcggagaagcatatattaacggacgtgctggtgaacgctttgccgttcgaaacagcggtgtgaacgtagttgtagaaggtattggcgaccacggctgtgaatacatgactggcggcagcgttgtcgttctcggtgatgtaggcaaaaactttgcggcaggtatgtccggcggaatcgcttatgtactggccgaagatgtcaaagcgtttaaacgcaaatgcaaccttgagatgattttatttgaatcattagaggacgagaaagaaatccagcaaatcaaagcaatgcttgaaagacatactgcatatacaaacagccaaaaagcagaagatttgcttgatcaatgggaagacagtgtgaaaaaattcgtcaaagtcattccgaaaaactataaacaaatgcttgcaagcatccaagagcaaaaagctgcaggtttatcagatgaagaagccatcatgttcgcttttgaggccaacacgaagccaaagcagaatacagcagcatcgggacaaaaacaagcggtagtacagtaaggaaggggagaggaacatggggaaaccaactggatttatggagatcaaacgagaaaaaccttcggagcgggaccctctcactcgcttaaaggattggaaagaatattctgctcctttttcagaagaagcatcgaaacggcagggggcgcggtgtatggattgcggtacaccgttttgccagatcggtgcggacattaacggatttacatccggctgtccgatttacaacttaattcctgaatggaatgatcttgtctaccggggcagatggaaggaagcattggaacgtctgttgaaaacaaacaactttcctgaattcacagggcgggtatgtcccgctccttgtgaaggatcatgcactttagcgatttcagacccggccgtatcaattaaaaacatcgagcggaccattatcgataaaggatttgagaacggctggattcaacctagaattccaaaaaaacgaacaggcaaaaaagttgctatcgtcgggtcgggcccagccggactggcgagtgctgaccagctgaatcaagcggggcattctgtcactgtttttgagcgctcagacagagcgggcggccttttaacatacggcattccaaacatgaagcttgagaagggcattgtagaacgccgaattaaattgctgacgcaagagggaattgattttgtcacgaacacagaaatcggtgttgacattacagctgatgagctaaaggagcaatttgatgctgtgatcctatgcacaggcgctcaaaaacagcgggacctcttaattgaaggacgcgattcaaaaggagtccattacgcgatggactacctgacacttgcaacaaaaagctatttagattctaattttaaagacaagcaattcattgatgccaaagggaaagatgtcatcgtaatcggaggcggagatacaggagctgactgtgtggctactgctctgcgtcaaaaagccaaaagcgtgcaccaattcggcaaacacccgaaacttccgccagcccgcacgaatgacaatatgtggcctgaacagccacacgtctttacgcttgaatatgcatacgaggaagcagaagcaaaattcggaagagatccgagagaatactccattcaaacgacaaaaatggttgcggataaaaacggaaagctgaaagagcttcataccatccaaatggaaaaagtgaaaaatgagcatggaaaatacgagttccgcgagctgcctggaacggaaaaagtatggcctgctcagcttgtctttatcgctatcggctttgaaggcacagaacagccgctgttgaaacagtttggtgttgattctgtaaataacaaaatcagtgcagcatatggggattatcaaacaaatatcgatggtgtattcgccgcaggggatgcaagaagaggccaaagcttaatcgtatgggcgattaatgaaggccgtgaagtggcgcgtgaagtggatcgatatttgatggggagttcagttcttccgtaaataaaggggattatcatataagagaaaccggtctggctgccagccggtttctttttttattccattacgatcccgatgtttccaaactgtctgccttcctgcattcttttatatgcttcacatgctttttctaaaggatatatccggtcaattacaggccgcagcttatgtttgttaatgaaagcgagcatagcttgaaattcctcaccgcttcccatcgaggttcccaaaacattgacctgaggaaagaatagagaacgcaccggaaaactgagattatcccctgagcttgccccaaagctgacaatacggccatttggttttacatggcggaagtattccgaaaagagggcaggtcctatgctgtcaagaacaacatccgccttttttccctgcaactgctcatcccaattgctgtagctgtcaaatgcgtaatcagcacctaattgcagcgccttttttcttttctcctcactgcgggaggtcacgcttactgttgccccaatcgccttagccataaataaagcataggttgccacaccgctgccgatgccgggtatcaatagatgctcgcctttttttaattgcccctttgtaaacagagcccgatatgcagttaaagcggataaaggtaaaacgcccgcttcttcccaagataaataagcaggttttttgattgcattttgtgaaggaatgatcacatattcagcaagtgttccgtccgaaggacctcccagaatctcaggtacaggtggtacattctctgttaaatcccagttcaatgtcgggaaaatgactacttctgtctgaacagtaacatttttcacgccttcaccaatctcttcgatgatacccgcgccgtcagaacccagtatcatgtgaggatcttgttccgatttgtttttcataagaaacaagtcacgatgattcaggcccgcggattttaatttaacctttacctctccgtatccaggctttgttgatggaacgtcctcgactgataacccctgaaggccggcttttccgttgtgaattacagctttcatgctgtctgcctcctcattgaattgtattttcatatctttacatattttacatagcggttttcttcgagtaaaatgaacaaatatgatagccaatatcacttttcatcatagcaagcaggtgagagcgcgtggaaagcggagatttaaagatttttcaggctgttgctcgcgaaggaagcataacgaaagcagcccaaatgctgaattatgttcagtcgaatgtgacagccagagtgcataaccttgaggaagatttgaatatcaggctttttcatcgaacgaatcgggggatgaagctgactgctgcaggagaaaatcttttacaatatgcagatcaagtattatcgctgttagacaaagctgaaaaatcgacccgtatgagcaggcaaccaaaagggcctttgcggatcggatcactggaaacgacggcggtaacgcatctgcctgagcatgcagcatccttcctcaggcgttttcctgaagtggatttatcagtgaacacagcggatacgcatcatttgattcaacaggttcttgatcataaagttgatggcgcttttgtatatgggccggttgaacacgctgcagttagacaactccatgtttcccatgatgaattagttttgatttcatcacgagaagggacggcagaagacatgcttcagcagccgatgctcttttttggggctggctgttctcatcgtgacagggtcaaaagattactagaggaagcaggcatagacaatcaaaaaatcataaagtttggcacattggaggctattataaaaggtgtttccgccgggatgggtacggcgctgctcccaaagtcctctgttgactgctccgagcatcgtacaaatgtatggattcatcaattgccaccagcatatcaagacttagagatcgtctttatatacaggaaagacttttttattacgagtgcgtttcagacatttcttgatgagataaacgaaatgaaaagatgaagatagacgtgcattagcagaataaagattttgtcaaagaagcagtcatcattctgtcattttggattgcaatcagggatacagagcatcagcaatgcccgttgttattaaagatctgcatgaaaaaactgtactcatttgaagcgagtacagtttttttatttatttacgttttaaattaatgccgatcgccgctccgtttctgcttgaatcagctacacctttaaaggtgccgttttcatggtcgatcgatatgctttgcacgtttccgatatccactggacttgtgccgaatttgtggcccatgccgtttagcttgctgaggacatctttaggaactccgtcttcgtaacggtaagagctcatgctgtttgtgtaaattctcggctcttcaacagctgcttttaattccataccatattcaatgtggtagagaatggtttgcaaaacggatgaaataattgtggccccgccaggagatccaacagtgaggacaggcttgtcatccttaaataaaatcgtcggggtcatgctgcttaaaggccgtttgtttggctgtacttcgttagctccgcctggtatcgcatcaaaatccgttaattcattgtttaaaataacaccgtaatcagggaccataataccggttccgaatagctgttcgattgttgttgtataggaaacgacatttccccaacggtcagcaactgtaaagtgggttgtttggccttctactttgtctttcggctgttcaacttgtttatagtttgctgatccttcttggtatttccaagggtcaccggctttcggttttttattcacttgatctaggttgattaattgctggcgttctttaatataatcggggtgaagcaagcctttgagaggaacatttacaaattcgggatcacctgcgtaagacgcacggtcggcataagacaaatgcatcgtttcagcaagcagctgatatttttcccatgagcggacatcgtattgtgaaaggttaaaatcatcaaggattttcagcatttgcaataagaaaataccgccggagcttggaggaggagtagtagcgatttgatagccttgatagtctccccaaatcggttcatcaattgtaatgtcgtaattttctaaatctttttctgtcattgatccgccgaaatcctggacagtgtcagaaagcgtcttggcgaattttcctttataaaaagcgtcagtgcctttggagcgaataagcttaaatgttttagccaaattcttttgaataagggtatctccttctttaagcggttcgccatttggtaaaaatacatcttttgcggcagtccgtgaaagtttttcctgataatcagaaatggcatctgccaacacagaatcaatcggaaagcctttttcagcgagtttaatagaaggggtaattaattgcttcatcgaacgggttccccatttatccaaggcttcttccagccctttcagagtgcctggaacaccaacggcagtaccttttgttacacgttcagagaaaggtattgcttttccgttttcgtccagaaacatatcaggagttgcgcctgctggagcacgctcacggctgtcgattatcgttgtatccttcgtttttccgtcatacaccatcataaaaccgccgccgccaatacctgacatcatcggctctgttacattgagtgcaaattgaatggcaaccgctgcgtcaatagcatttcctccttttttcagcacatcagcaccgatttcagaagcaagaggatgtgcggtcgcaaccatgccgtcttttccaacatctacttgtttgtactcatcgtagcttttgggcggttttttagcttccgcgtgaaaagggacacttccagcgactaacagaacactaagcagagctgttaaacagacgttccacgttcttttcatgttctccctcctatatgaagctgtattgttacaatcttagcgtaaaaaaattacagcgttttcacaagtgacaaatggtatattatatagtacataaagccgtttttctgtgcaaaattgattatattgatatgagccatgtgctatattagaatcagcatacggattaagaagggactgctatatgtatttaacgattgaagaaacagcagaatatacaaatctttcagaggattatattaaaagcttggtgctcgaagggaaaatcagagccgttcatgacggggagcaatttttgatttataaggaacagttcaaaacgcatctcgaacagctggagaattacaaagcactggtgcatgaaatattaaatgaaccgatcccggaagatattgatgtaaaggatgaggattaggacacaatttgaaattgtgtctttttttgtatatttttgcggaagctccagaaaatcgggagtgtcagatttcgttttaagaggttttttgatgattagtagggggataagtatccaagaggttaaaagctttataagaggctttaaagcttattttatagggtgaaggttggaagaagcttttttaaaagcttatgtaacactatgtatattatgttacataaatgccgccgcactttgacattcaacgtttttcagctataatagtaacatagacctcaaaacgttacataacggtttttaaggagttttttgatgcatattgtacagccgattcgcagtctagaaaaaatccaagaagtcaaacagtatttgcttaacaaaaacaagcgggattattttctgtttattttcggcatcaacagcgcgctccgcatttctgatattctgccgctgcaagtgaaggacgttcaaaataaagatcatttatgggcgactgaaagcaaaacgaaaaagaaaagaaagattcttattttagaatcgctgaaacaggaaatatacgagtatacgaaagacatgaaggaaaacgaatatctttttaaatcagtgcggaccaggaagccgatttcccgcattcaggcctacagaattttaagagaggccgctgcggcgtgcggacttgaggagatagggacgcatacactccggaaaacgtttggctatcatttttatcagcgaacgaaagacatcgccgagctgcagagaatactgaatcattcatcaccatcaattacaatgcggtatattggtattgatgaagatacaacaagagccgcgtataaggtttttggagggctttaatacaaatcgcttgaaaatattgatcatcagagctactatataaataccaaaagctctagtagcacagcggatagtgcagcagtttcctaaactgcaggtcgggagttcgaatctctcctagagcgttatacacaaaaagacaacaggcacttttcgcctgttgtctttctttatgcaaaccaaattaaaaaacgcccgcttatcccgggcgtttttcttatataactgcgtcaaattgattgactttccattttttattttctttcacaaatgtcactttccgttttgcagaaggggatccgtctaatgcagggacggtaaattcgtatgtgattgtgctgccttttttagagatcagtttagcagttgattttttccaattcaaaagattgtctccgtcaccgattggaacagcaagttttccttttgaaacagtgaaatgataatctttaaagcctttttcgattgctgtttttgtaaaaataggagttaaataattcaccgcttttgctttagtgcctagatcactgcacatgtatacatattgaagattttgatactcgaatgtgcctgatgggcaaactgcttttttcaccttcggattgtggccgctcatggtgttccaaaaatgttctctagcggataatgccaactgtaatgcttgtttttgtgataaatcgcctgatgtatttttcgcaaatgcatttgtgcttaatgacagaataagtgcaatggttgttagaaatagaagacattttttcattatcgctctctccttcaaaatctctttctcttatgttacaaatgttacaataattactgatagattacaatacttttgcataaattattttttattcttttactcacaaaaaatacgccattacttgctagtttattcttcataagctaaaaagatgtgtaaaattagaagaatcgggaagggtttcataagtgcagtgatgaataataacatgttacatatcctgtttttgtcaaaaaatgagggcatgtttaaaaacgatttcaaataaaggagtcctttaatatggaaacatcacaagaacctcttgtaactcaaaagaaaagcaaaccatcagtttggcggtcgatgtcactctttttagtgccgcttctgctgagcaatgtgctgcaatcagtcggccagctagtcgggatgatggctgtaggcagatggctaggtgttgatgcagtggcagctgtatcatcctttttcccgttattttttcttttaatctcatttacaattgggatcggttcaggaagttcgattctgatcggacaagcttacggagcgaaaaatgaggaacggctaaaggctgttgtcgggacgacgctcacctttacatttttattaggcgttgtgttagccgtcatcggcagtattttcaccctggatatccttcgtttaatgggaacacctgaaaatgtcattcatgtcagcgctaactatgcacgtattttattttatgctatgccatttatgtttttatattttgcatatactacctttttgcgcggaacaggagattccaagacaccgttttatacgctgattgtgagcacggtcatcaacatcgcgcttttgcctgttttaatccttggcatgtttggttttccgaaactgggcatatacggctcggcatatgcaactgtcatttccacgattgcgacttttctcgtgttaatagtgtatttacgaaagcgaaaacacccgctgcaatttgataaaacagtgcgtcgttatttgaaaatggataaggaactgctggttctcctgctgcgtcttggggtcccagcaagcatcaatatgattcttgtctcattatcagagatagcggttatttcattcgtcaatcattacggctctaatgcaacagctgcatacggagtggtcaaccaggtggccagctatgtacagatgccggccgtcagccttggtattgcggtttctattttcgctgcgcaatcgatcggagcaaacgagtctgaccgcttaaagcaggtcattcgcgttgggatttggctgaattatatcattggcggcgtactgatcattctgatctatgttttttcacatcagattttatcgttatttttaaccgagcaagagacgctttacattgcgcaccgtcttttgatgattacattgtggagctatttgctgtttggaaatgcccaaattatttctgcaacgatgcgggcaagcggaacggttttatggccgaccgtcatcagtatttttgcaatctggggagtagaggtgcctgtcgctttcgtcctttctcactatacaaagcttgaaatactcggcgtctgggttggttatccagctgcgtttgccgtcagcttgctgttgatttatgggtattatcaattcgtctggaaaaagaaacaaatcacacgtctcatccaatagcctccgaatcacaccgttcataagtttgaacggtgtttttttatttgataggggaaaatataaaatggaggaaatatggcacagtacattgaattcttatactagcaatgaatcaaggagaggttgagtaaacatggcaaactttattgagaaaatcacgtatttgggaacgccggccatcaaagcgggcaacgaacatctagaaatgattgttgtccctgagtgggggagcaacgtcatttctctcgtggacaaaacaacaaatgtccagcttttgcgtgaaccggaaacagtagaaagttttcacgacacaccaacattgtatggcattccaatcctgttcccgcctaaccgcataagtgacggtacattcagtttccggggcagaacgtatcattttgatatcaacgagaaggataaacacaaccatcttcatgggtttctttaccatgaaaagtggaatgtcgtgaccacgaagaaaactgatgaaggagtgattgttgaaacagaaattgatctttctgagcttccccatgtgcagaatcaatttcctcatcatgccgtcgttcggatgacatacacgatcaaggggaataccctatttaaacatgcgacggtcatgaacaaaggaaaggaagcgtttccttggggaattggttatcatactacatttgtgtttccggcagaaagctcgttattctccctgacagcagatcagcaatgggagttggatgaacgcctgctgccgaccgggaaactgatggatgtaccgaataaagaagctttgcatgaaggaatggatttgcgccacaagcagctggatgatgtctttttatcttcttatcagaagaggggcggagaaaaccaggcagtcatttatcatcagcatgcacatatcagcattatttataaggcagatgaacagtttaaacattgggttgtatacaatgcggacggaaaacaagggtatttatgccctgagccttacacatgggtgacaaacgctgtgaatcttgatttaccttcgtcactcactggtttacaagtgctggagccgggagaagaaacgacagctaaaagcagtatcaccattgaactgaatcatcaatagccaatgatgaagcgcagagaggcggggaaattaatgaaaaaaagcataaagctttatgttgctgttttactgcttttcgtcgttgcttcggtgccttatatgcatcaggctgcgcttgccgctgaaaaacaagatgcactttccgggcagatcgataagattttagctgatcatcctgccctcgaaggcgcaatggccggcatcaccgttcgctctgcggaaacaggtgctgttctatatgaacattcaggagaaacccgaatgaggcctgcctcttctctaaagcttttgacagcggccgcggcactttctgtccttggcgagaactattcttttacaaccgaggtccggacggatggaacactgaaagggaaaaagctgaatggtaacctttatttgaaagggaaaggcgatccgacacttttaccatctgattttgacaaaatggctgagaaattgaaacattccggcgtaaaagtaattaaaggcaatctgatcggtgatgatacgtggcatgatgacatgcgattatcacctgatatgccttggagcgatgaatacacatattatggcgcgccaatctccgctctaacagcgtctccgaatgaagactatgatgcaggcactgtgattgttgaggtcaccccaaatcaaaaagaaggggaagagcctgccgtgtctgtctctccgaaaaccgattatataacgataaagaacgatgctgaaacgactgctgccggttcagagaaagacctcacaatcgaaagagagcatggaacaaacacgattacaattgaagggagcgtaccggttgacgcaaacaagacaaaggaatggatttctgtctgggagcctgccggatatgccttagatttatttaagcagtcactaaaaaaacaaggtattacggtgaaaggggacatcaagacgggtgaagcacctagttcttcagatgtgctgctctctcatcgctcaatgcctttatcgaaactttttgtgccgttcatgaaattaagtaataacggacatgccgaagtgttcgtaaaagagatggggaaagtgaaaaaaggagaagggagctgggaaaaggggctcgaagtgttaaacagtacgcttccggaatttggtgttgattctaaatcactcgtcttaagggacggatcaggaatctcacatattgatgctgtatcctcagatcaactttcacagctgttatatgacattcaggatcagagttggttcgcggcttatctaaattctttacctgttgcgggcaatcctgacagaatggtgggcggaacgctgagaaaccgcatgaaagacactcctgcacaaggaaaagtaagagcaaaaaccggatcgctcagtacggtaagctctctatcggggtacgcagaaacaaagagcggaaaaaaacttgttttctctattcttctaaatggattgattgatgaagaggatggaaaagatattgaggatcaaatcgctgtcattttggcaaatcaataatagcggcagacctgttttccaagagaaaacaggtttttttatgtctgtaataacgctttgtcgaaccttccaacaattagaagaatgatgcacaaaagaaaattagttcgattaaaaagtagtgtataagaccttatgtaaaacaatacttttatcactttatatccggaaatttgataaaaaaagaaacgaaaaataaagaaataatactatattcaaaaaaatgttataaaaatttaatgttttttattgtactttaaaaaatatccgttaatatagtgcatatatggattatatagtcatataatttcttttattgacatttttctgctttttcttatcctcttattatgagaactggagggaatccgttgagcgaacatacttattctttaacccatgcccaaaggagagtgtggtttaccgaactgctggagccagataccagcatttgcaatctcacagcctgtgtgaaattcaaaggcaatattaagcttgatactctggagggagcgctgaatcattccatctcccgcaacgacgccattagatttcagctgttagaaggagaagagcttgagccgcgattgcaccttactgaatataaatattatccacttagaataattgatttttcaaatgttgaaatgatagaaatagagcaatggattcaggatcaagcgagcattccatttaaactgttcaactcgcctctttatcaattttacctccttagaattgactctcatgaagtttggctatttgcgaaattccatcatatcataatggatggaatctctttaaatgtgatgggaaatcaaattatagatctttatcaaaaaatgaaaaagaaagatcctttacctgatcagccggaaccttcttacttgagctacatcgaaaaagagagtcaatatctacaatctccacggtttgcaaaggaccgtttattttggacgcaaacctttgagcacccgttggaataccactcgttagccgaccagacgtccttacaaaaacagagcacatctgcatccagagacaccatcattctttcacctgatctagagcaaacgattcgaatcttctgcgaagaacacaagatcaatatcatttccttatttatggcttcattttacatatgcatcagccgaatcacttctaaaaaagatcttgccattggcacctactatggcaacagaggttcaaaggctgaaaaagaaatgctcggcatgttcgttagttcccttccaatcagaataacggttgatcctgacacagattttctttcctttgtccgcacaataggcagggaacagctttctgttatgcgtcatcaacggtttccttataatttgcttgtaaatgaattaagaaatgaacagaaggatttacacaaccttatcggtatatctatgcagtatcagccacttcagtggcacaatgcagatgattttgactatgaaacagcgctttatttcagcggatacaccgcgaacgaactttcagttcaaatacaagaacggatagacaatggaaccattcaattaaatttcgactatcaaaataccttgttttctcttgaggatattaaacgaatacaatctcatctgcttaccatactggaaaacgcccttcaacatccgcacagctttataagagaattagatatgacgaatacaagagaaaagcaaaaattgttgtatgagtttaacaagacggaagctgtttcgcctaaagctttcaccctgcatgggctgtttgagcgacaggcagctttcacaccggagcggctggccattcgcttttcaggcggttcgctgacatacgctgagcttgatatgtacgccagccggctggctgcgcaccttgcggcacgcggcgtctcaaacgaaagtatcgtcggtgtcctgtctgaacgctcacctgacatgctgatcgctgtccttgctgtactgaaggccggcggggcgtatttgccgcttgatcctgcgtatccaaaggagcggctgagctacatgctgaaagacagcggggcatcgctcttgctgacacagccgggatgctccgcaccgaacttttctggcgaaacgcttgaagtggacatgacatctcttgcgagagaaaaagcagaaaaccatctgtttactcctgctgacggcggttctctcgcctatgtcatctatacatcggggtctaccgggcagccgaaaggagtggccgttgagcaccgccaagctgtttcctttctgaccggcatgcagcaccagtttccgctttcagaagatgacattgtcatggtgaaaacctctttttcctttgatgcgtctgtgtggcagctgttttggtggggaatacttaggctcggtagctcagttggtagagcaacggactgaaaatccgtgtgtcggcggttcgattccgtcccgagccaccacctatgccggtgtagctcaattggtagagcaactgacttgtaatcagtaggttgggggttcaagtcctcttgccggcactgttttttaaaaatttaatgtggaggggtagcgaagtggctaaacgcggcggactgtaaatccgctccctcagggttcggcagttcgaatctgcccccctccatcatttataggggcatagtttaacggtagaacagaggtctccaaaacctccggtgtgggttcgattcctactgcccctgccaaatttatgacatcttgagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagtctcactttttatatcaactgcatataatgtattaagtccattaaaaatgcggaagtagttcagtggtagaacaccaccttgccaaggtgggggtcgcgggttcgaatcccgtcttccgctccaattacggcggcatagccaagtggtaaggcagaggtctgcaaaacctttatccccggttcgaatccgggtgtcgccttcttattgccggggtggtggaattggcagacacacaggacttaaaatcctgcggtaggtgactaccgtgccggttcaagtccggccctcggcaccaattttacttacatggtaagttgaattggtgtttgtgttttatcattataactaatcatattaatgatctacataagtagatcatttttttaatgctttgatttatcataacaagttaagttccgaggcctattataaagcggctgtatagctagtctttcaacacttttattttatatttccataaaaacttttttgaaatacgttgacactttatgagatccatgatatatttatattcgtcggttagatacgacgtaaaacttgccggtgtggcggaattggcagacgcgcacgactcaaaatcgtgttccttctggagtgtcggttcgaccccgaccaccggtatactgaaaaacccgtttcttaacagaaacgggtttttattttttattaaagaaaaggagccgaggctcctttttatacttactcagcgtattggtctaggatctcttctagcacctcttctagctcttctgtatcttcaagctctgattggctgaaacggacgcgtacaagctgttctccgtcattatacatctcttccaaccaccctcggagtcctcttgctctgcggtcgacttcgaaaatgatttccaaaccgtcttcgtctaaaaggaaaatgagctctaattcatcaagcatctgacgataatatccggaagtcggaacgaattcgaattcttgaacgaacggaagacgacgctggaagtagggcgcttgttcgcagtctgcttcgttaagatggaagcccaggttttcgattgcttcaagcacattttcaatccaagggtgcgcttcaacgaaaatgcggtcatgatcggatttatcgataccgccttgaatgtcaaggtctgtcaccacggcaacctctactttccctacagtgatcggcgtatctagaggcagagtgaatgtgaacggaaattgatgctcttcaccaggctgaatggtaaatgaaccagtgacccggaaagaatgaattgtagcgtatttccggtgctcttcatcgtcttttacaatgacataccgtgtactaagctgtaaatcgatataacggatgtcctgagcgatttttccgcctttgacatgtaccgttccccgtacttcttctccaggaaaatatgcgtctttctctaaaatagtatcaacttttgctgctccaattccggcacttgccgcaagcttcttaaaaagtgacatgttagatcttcccctttttcttttttctcaacagatatacgtaagaaggaggaaaaaagattcatctgattcatacttttttcctattattcgtctcggcctagggacagactaagaataatattgaaaataaaggagtggatggaagtgaataaagaaagtttggttgcagatgaattacacagaatgtttttggctggtgagctgcaaatcacagtagaggaggatataaacagtatttccgaaaggctgagaaacggtgatctcagtttagaccgattaagcggtgaagacgtgtttataaaagaaacggtaaatgaggctttaagaagagtggagcaataaaaaagagacggcatctcatctttgagatcccgtctctatttgtggtctttgctgtaagataaaagcgaatcgatttggaattgctcacccgagccaccccttttctaacagaagatctgacagttcatcatggagataaacagctgtatctaattgatcatgcaatgctcttctgatgtggggattttcggttgctgttgttgcgacagtgtatttgttaatgctggtttttattgttgttaacaaatcaagaatatctttgggacaaagactttgttcaatgggaaaccacctcctttgtttttttagcagctcctgataagaaagtatttggctttgtttcttgcttctatacaaaatgctataataagcaacaaattttgttggggggtgtgatgatgaagcagattattgcgatggggggcgggggtttttcgatggatccggataatttgtccctcgatcaatatatcctcaatcaatcaaaacgagagcagcctcgtatttgttttttgccgacggcgagcggagattcccaaaactatattcagcggttttatcatgcatttaaaacactggattgcgtgccgtctcacttatctttgtttaagccgccatcaacagatgtaacttcttttgttatggaaatggacgtgatttatgttggcgggggaaatacgcggaatttacttgtgttatggaaagagtgggggcttgaccagattcttagggaagcatggaagaacggtgtggttttagctggattaagtgccggtgcgatctgctggtttgaagaaggggtgacggattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcggaaggaaaggcatatcgggtgatgatggctgaacatgaaatagctgaaatcccgttgccggtcaaatatttagggtgaaattggctgaatattatctatattcctctttttttcagattgattttatgataagatgagtgcgaaatcaatagttactgggggtgcccgctttcgggctgagagagaaggtaagcttcttaaccctttggacctgatctggttcgtaccagcgtggggaagtagaggaattgtttttgttattgtcttgctgggcaataatatgtttctttctgactgtaaccgggttcatttatatgaatccggttttttgtgctggttatgggcttgattttgtcctttcaaacgtagagaggggaaggaaaagtaatgcaaaacaattcagtgcagcaagccaacatttccattatgtcaagtttttcaggcagcaagaaggtatacgtggagggttcttcttcggacatccaagtgccgatgagggagatcctattgagtccgacgacgggatcgttcggcgaagaggaaaacgcgcctgtgcgtgtctatgatacaagcggaccgtatacggaccctgaagtaaccattaatattcaagaaggattaaagccgctccgccaaaaatggatcacagagcgcggtgacgtggaagagtatgaaggtcgggctataaaaccagaagataacggttataaaaaagcaaatccaaacgtaagctacccaggattaaagcggaaaccgctgagggcgaaggcaggtcaaaatgtcacacaaatgcactatgcaaaaaaggggatcattacacctgagatggaatttattgccattcgtgagcatgtgtctcctgaattcgtcagagacgaggtagccagcggccgggcgattattccttcaaacattaatcaccctgaaagtgagccaatgattatcggccggaattttcatgtgaagattaatgcaaatatcgggaattcagcggttacttcatccattgaagaagaagtggaaaaaatgacgtgggccatccgctggggagcggatacgatgatggatctctctaccggaaaagatattcatacgacgcgtgaatggattatccgcaattgccccgtgcctgtgggaactgttccgatttatcaggcgcttgaaaaagtaaacggcgtagcggaggatttaacgtgggagatttatcgtgatacgctaatcgagcaggcagagcagggagtggattattttacgattcacgcgggtgttttgcttaggtatgtaccgctgactgccaaacggacaactggtattgtgtcacgcgggggagcgattatggcgcagtggtgtctggctcatcatcaagaaagctttttatacacacattttgaagaaatatgtgagattatgaaaatgtatgatattgctttctctcttggggatggtttgcgtcccggatcaattgctgatgccaatgacgaagcgcagtttgctgaattagagacgcttggagagctgacgcaaattgcctggaagcatgatgttcaggtgatgattgagggtcctggccatgttccgatgcataaaatcaaagagaatgtcgataaacaaatggacatttgtaaagaagcgcctttttacacattggggccgttgacaacggatattgctccgggatatgaccatattacttcagcgatcggagcggcgatgatcggttggtatgggacagcaatgctttgttatgtaacgccgaaggagcatttggggctgccaaaccgtgatgatgttcgtgaaggagtcattacatataagatcgctgcgcacgctgcggaccttgcaaaagggcatcccggagcacaaatccgggatgatgcgttatcgaaagcccgttttgaattccgctggcgggatcagtttaatttatctcttgatccggagagagcccttgaataccatgatgaaaccctgcctgctgaaggagcaaaaaccgctcacttttgttccatgtgcggtccgaaattttgcagcatgagaatttcacaggatattcgggattatgctaaggacaaagagattagtgaatgggatgctattgaagaggggatgaaagaaaaagctgaagaatttgtgaatcaaggcagccagctgtataaataatagattgacagtcgaaatggaatgcgttttaatatagctaatatccatttccagtatttgctgatcgggacaccgaaggctcttatcttttagataagggccttttttgtatgaaaaaggagggattattgatgggagtcaaaaaagaaaaggggagaaaacgattcaggaagcgaaaaacctacgggaatcagattttgccgcttgagctgctgattgaaaaaaacaaacgagagattataaacagcgcggaactcatggaagaaatttatatgaagattgatgagaagcatacgcaatgtgtaactaaatataaaaaaacccgctgactacagcgggtttttgcatttctacattaagcatcttttttaatcggcaatccaaggccttctgccacgcgttttccgtattcaggatccgctttgtagaagtgctcgatttggcgcagcttgatttcttctttttctaccggcttcatagcattaacgatattttcaacaaggcgggtacgttcatcttcactcattaaacgatacagatcaccggcttgagtgtagtgatcgttgtgatcgtagcttacgctgtcagcgataccttgtaccggatatgctgcttgcttatcttcaggtgactctttcggaccgccgaagctgttaggctcgtaatacacagatccgccgccgttatcatcaaaacgcatttgcccatcacgctgataattgtttactttgttgcgtgcgcggttgattggcagcgcttgatggtttgcaccgacacggtagcggtgtgcatcatgataagcaaaaagtcggccttgaagcattttatcaggagaaacatcaataccaggcacgagtgttccaggtgaaaatgtcgcttgttctacctctgcaaagtagttttccggatttctgtctagaaccatgcgtccgacctcgattaacgggtagtctttttgagaccaaacttttgtgacatcaaacggatcgaaacgatacgtatttgcatcttctaaaggcatgatttgcacatatagtttccatgcaggataatcaccgttttcgattgcgttgaaaaggtcttctgtatggtaatcagggttttcaccggcaatttttgctgccgtattgacatcaaggtttttcacgccttgttctgttttaaagtgatatttaatccatacgccttcaccttcggcatttgtccatttgaatgtatggcttccgaagccgtgcatgtggcgaagtgttgcaggaattccgcggtcagacatcaggattgtcacttggtgaagtgactctggtgaaagtgaccagaaatcccatacagccgtagggttttttagatgtgtttttggatctcttttttgtgtatggataaaatcagggaacttaatcgcatcgcggataaagaatacaggcgtattgttgccgacgatgtcgtagtttccttcttcagtataaaatttaacagcaaatccgcgcggatcgcgaactgtgtcagcagagccaagttcaccggcaactgttgagaaacggatgaacaacggtgtgcgtttgccgacttcagaaaggaaagcggctttcgtgtattttgttacgtcgtttgtcacttcaaaatatccgtgtgcgcctgctcctttggcgtgaacaacacgttcaggaacacgttctcggttgaaatgggccaatttttcgagtaaatgtacatcttgaattaaagttggtccgcgagaaccggcagtcattgagttttgattatctccaaccggagcgccccagctagttgtcagtttatttgaactcatgttatcacctcttggaatttataagaacataatatcatctctaagtaaaaagtcaatattattttataattattataaaatagttatctctattaatcgatatctagtatcgaaagtgttgaaaaaccttgttatatcagcttttgatagtatttaataattttcaaagaaatccttgttttttctctacttgcgaaacaagcagagtaagtgataaacaaggatatcaaaaatcgtatttaaaaaagagttgacatatcggaataatttgaattaacatgttattcaaacaaaaaaacaattgggcagctgatcggaccgccgaaggctctcatctctacaagaacagagatgggggcctttttgtttttttgaaggcggggttggcagaaagagagggataaaagtggctgtgaccatcagcatcaaagaaaaggcatttgttcaagagggccgcaaaaacacggtcttagagaacatagaattatcaatcgcaccaggcgaatttctaacgcttatcggaccgagcgggtgtggaaaaagcaccctgttaaagattattgcagggcttgattctgaatatgacgggagtgttgaaattaacggccgcagcgtaacagctccgggtattcagcaaggatttatttttcaggaacaccgcctctttccttggctgactgttgagcagaatattgcagccgacttgaatttgaaggacccaaaagtcaaacaaaaggtggatgaactgatcgagattgtcagattgaaaggatcggaaaaagcatatccgcgcgagctgtcaggcggcatgtcacaaagagtagccatcgcccgggccctgctgcgggagcctgaggtgctgcttttagatgaaccgtttggtgcactcgacgcttttacaagaaaacacctgcaggacgtgctgctggatatatggaggaggaaaaaaacaacgatgattctcgtgactcatgatatagatgaatctgtttatttaggaaatgagcttgcgatccttaaggccaaaccggggaaaatccataagctgatgcccattcagctggcgtatccgcgaaaccggacgactccggatttccaggcgatcagacagagagtgctgtcggaattcgagaaaacagaagatttggagtacgcagaaggatcagggatatagaaagggcggaagcggaaatgaaaaaaggactcattgtattggtagccgttatttttctgctcgcaggctgtggagcaaatggagccagcggtgaccacaaacaattgaaggaaattcgtattggtattcagcaaagcttaagcccgcttttgatcgcaaaggaaaaaggctggttcgaagatgcatttgaaaaagaaggcatcaaagtgaaatgggtggagtttcaaagcggtccgccccaatttgaaggccttgcggcagacaaacttgatttttctcaagtcggtaattcgcctgtgatcgctggacaggcggcaggcattgactttaaagaaatcggtttgtctcaggacggcttgaaagcaaacggcatccttgtcaatcgaaacagcggcattcaagacgttaaggacttaaaggggaagaaaattgcagtcgccaaaggcagcagcgggtttgattttttgtataaagcgcttgatcaagtggggttgtcagctaacgatgtgacaattattcagcttcagcctgatgaagcagcttccgcatttgaaaacggatctgttgatgcctggtccatttgggagccgtacttgtccttagaaacaatgaaacacggggcaaaaatccttgtgaacggagaaagcacagatttatattcaccgggttttactttagtaagaacaaagttttcagaagagcatccagacgaagtggtccgttttctgaaggtgtttaataaagccgttgtatggcaaaaggaacatctggatgaagcagcggacttatattctgacattaaagatctcgataaaaaggtcgtcgaaaatgtgctgaaaaatactgagccacttaatgagatcatcagtgacgacattgtgaaagcacagcaggaaacagcagattttcaatttcgaacaaaggcgatagataagaagattgatgtgaaggatgttgtcgataacacttttatcaaaaaagcattaaaggaacattcctcaggaggtgatcaatgatgaaagcagaggctgcgggctcgctgcccaaaacgaatgcggaagcggtgcgaaaaaagcccggaaggaagagatacggctggatgaaggggcttttactgcccgctgtcatcattgccatctggcaggtcatcggcgggctgggggttgtgtctgctacagtgctgcctacacctgttacgattgttctgacctttaaggagcttattttgtccggcgaactgttcggccatctgcaaatcagcatttatcgggcggcgcttggttttttgcttggcgcggggcttggattgatgatcgggattttggccggattttccaaacggacggagctgtatcttgatccgtcgttgcaaatgcttagaaccgtacctcatctggccgtcacgccgctgtttattttatggttcggatttgacgaagtatctaaaattttgctgattgcgctcggtgccttctttcctgtctatatcaatacgtttaacggcatccgcggggttgacgcgaagctgtttgaagtcgcccgggtgcttgaatttaaatggcatcagcagatattcaaagtgatattgccggcagccctgcccaatatattgctaggcattcgcttatcgctcggcattgcatggctcgggctcgttgtggcagagctgatgggctcaagctcgggagtcggctatatgatcatggatgcgagacagttttcacaaacgaataaagtctttgcagggattatcatttttgcagtggttggaaagctgacggattccttcgtcaggctgcttgaacgaaagctgttaaagtggagaaacagctacgaaggataaaagatataaaggggagatgaatatggaaattctttggtttataccgactcatggagacgcgagatatttaggatctgaaagtgatggacggactgcggatcatctttactttaaacaagtcgcccaggcggcagacaggctgggatatacaggagttcttctgccaacgggaagatcgtgcgaggacccgtggcttacagcttcggcactggcaggagaaacaaaggacttaaagtttttagtcgcggtaagacctggtttaatgcagccttctctggcagccagaatgacatccaccctagaccgcatttcagacggccggctgctgatcaacgttgtggcagggggcgatccgtatgagctggcaggcgatggcctgtttatcagccatgatgagcgctacgaggcaacagacgaatttttaaccgtttggcggagacttttgcagggagaaacggtttcctatgaaggaaagcatataaaagtggaaaacagcaatctgcttttcccgccgcagcaagagccgcatccgcccatctatttcggtggttcgtcacaggctgggattgaagctgccgcaaagcatacagacgtgtacttgacatggggtgagccgcctgaacaagtaaaagaaaagatagaaagagtcaaaaagcaagcggcaaaagaagggagatccgttcgatttggcattaggctgcatgtcattgcccgtgaaactgaacaagaggcatgggaagcggcagagcgcttgatcagccacttggatgatgacaccattgccaaagcgcaggcagctttgagccgttacgactcttcaggccagcagcggatggccgtccttcatcaaggcgatcggacgaagcttgaaatcagcccgaatctgtgggcggggatcggcctggtcagaggaggggcaggaacagctcttgtcggtgatccgcagacgattgccgaccggatagcggagtaccaggcactcggcatagaatcgtttatattctccggctatccgcatttagaagaagcgtattattttgcagagcttgtatttccgcttttgccgtttgaaaatgatcggacgagaaagcttcagaacaaaaggggagaagcggtaggaaacacttattttgtcaaagagaaaaatgcatgagtttaactaaaatacagccccccgaacatggtatgatattcaaaaaaagggggctttttttctgaaaacattgagaagcgcggcagtcatttgcctcatagctatgctgtcagcatgcggacattcaaaacagatggaaatcaaagcggcggacatatcagatcttgaaaaaaacagaatggatgtcgcagcttcacaggcattcactgccgaagccgtcaatatcggtgaaggtatttcttcagctgacatgtacatcgaacattatcaaaagggaaagcttgttgagaggtttggaccggttcgtgcagattattcagaggaaaaacccgataccatacaatttgtttattttgagaatgaagagggggaaggaaagaataaacataccaccattcattttggcattgtggataaacagggaaatatagcggctgattcatcggtgaaacgagacgatagcacaacacaggaaatgactcagaatatttcatcgccggaaccgattactttcgagaagcctgctttgatcggcagcagtattagagggactgacgagacaatgcacacctctgaacataaaaaagagctcattaagcatcaagatgcgttactgtattatgtggaattgcatcattagagtgggcggcttcaagccgtctgttttacaaagcggtatgcttgcttttttgaatggtgcatgatacattttaaatcgtaacaatttcgatttaaagggaggctatgtgacttggctaaaaaatcaaaagtggcaaaagagttaaaacgccaacagcttgttgagcaatacgctggtattagacgcgagttgaaggaaaaaggagattacgaggcactcagcaagctgccaagagattcagcaccgggaaggcttcacaaccgctgcatggtaacggggcgcccgagagcatatatgaggaagtttaaaatgtccagaatcgctttcagggagctggcccataaaggccagattcccggtgtgaaaaaagcaagctggtaagaaaaaactccggccgattacagcgcgccggagtttttttcgtttttcttgaaagagatgacgtaggaaaggtgctggatgatcatgatgataaacacaataataatagggaaaaacggaatgcgcgattgaaatagcggataaaaaatgagaagaaccgctgcggcaggcagcgagaagtagacagcgatatatgacgcgcgacatgcttttgccgtcatcatctgctctctttcatcctgctcttcaaactcatcaggcagaagaagctgttttctggcagggcggctttttttctgtaagtacaaataaaccgcagacgccgcaacaaacagaataaagggggtgaggtttaattcaaacaccatcccgccgctctttgtgcgaaaaaaagatgcaattccttctgacgcttcaaagtatgcaatcagcgtccagcatgcaaggccaaataacacaagttgaaaagctgcttttgttttcatgctcatcttagttttcctcctctaaccaaaagacatcctccattttcatggagaaggctttgcagattttcagtgctaacagcagtgagggaacataatcgcctttttcaatcgctgccacagtctgtcttgtgacgccgactgtttctcctagtttttcctgagaatagccgaagcgtgccctcagctcttttactttatttttcatcatgacgtctgtccccttcacaatctcgattgattatattgtatagtatacttaacattatgtaaatggaacttaacaactttacaaaaagataactttttttcgacaaaatttttatattcccttgacgaaaaataaataaacatgtaatataaaaaaagtcagagcggtactgttgctgacaatcataaatgcgggtgtagtttagtggtaaaacctcagccttccaagctgatgtcgtgagttcgattctcatcacccgctccatacatacgttattaacgcagtgtttcgtttctcagataaacgaagtattgcgtttttttatgtaaaaaagaacacgacattcgtgttcttttacgtaagccaatgtactgtatgggtgccgccgtgaatttgttcaaacattttcgttaatgatgataagaggttaacagcgctgcttttctcaatcgatggcgggaaaaaaatgatttgcagcatattcttagtctcgtttgaaacgggatagtggttgacgttgtttttgaaatcgccaaaaatgccgttttcatcagagaaaagcagtatgttttctttttctcccaatgagatccggaccggctcatgaagctttccggcatcataaatcataataggcagagaatattttaatgcgaaaaaatcgattgtgtcatgggccgagtctttactttccatgaattgttccttggatatcgggaccagcatgtcctccattggggttgtttctccctcaaatgaagggttaagctgtttaaagagttcctgccattccttgacgaaggattcatcggatataccgccgtccgcatagtcgaaaaacaaggattcttgaaacaggcggagtctgcctttcagcatttgcggtgaggagccgacttcgatattctcataaatgacagcagctgcatgtaagccggccgcacgttcagtaataacagaatcaagtttgatattcactagcattcactccagttacgtgatatcaacctattataaacgctgtatcgttttatcacaaagaaaggaggctgtgcaaaacatgaacgtttatcagctcaaagaagaattaattgaatacgcgaaaagcattggcgtggacaagattggttttacgaccgctgatacttttgacagtttaaaagaccgtttgattcttcaagaatcgctcggctatctctccggctttgaagagccagatatcgaaaaaagggtgacgccgaagcttcttttgccgaaagcgaaatctatagttgcaattgctctcgcatatccttccagaatgaaggatgcgccgagaagcacgagaactgagcgcaggggcattttttgcagagcttcctggggaaaagactatcatgatgtgttgagggaaaagcttgatctgctggaggattttctaaaaagcaagcatgaggatatcagaacgaagtcaatggttgatacaggtgaattgtctgatcgcgccgttgcggaacgtgccggaattggattcagtgcgaaaaactgtatgatcacaacacccgagtatggctcttatgtgtatttggcggaaatgatcacaaatatcccttttgagcctgatgtgccgattgaagatatgtgcgggtcctgcacgaaatgcttggatgcctgtccgacgggagccctggttaatcccgggcagcttaatgcgcagcgctgcatctcttttctaacccagacaaaaggatttttacctgatgaattccggacaaaaatcggaaaccgcctgtacgggtgcgatacgtgccaaacggtatgccctctcaataaagggaaggattttcatcttcatccggaaatggagcctgatcctgagattgccaaaccgttattgaagccgcttttgaccatcagcaatcgggaatttaaggagaaattcgggcatgtctcaggttcttggcgcgggaaaaaaccgattcagcgaaacgccattctcgcgctagcgcattttaaggatgcttccgcactgcctgaattggcggaactgatgcataaggatccgcgtcctgtcatcagggggacagccgcatgggcaatcggaaaaatcggagaccccgcatacgcggaagagcttgaaaaagcgctggaaaaagagaaggatgaagaggcaaagctggaaattgaaaaaggaattgagttgctaaaagcttcaggcatgactaaacaaggcttgtcctgacatacgtatagagcagaaggaaaaaacacttgagatcatccaagtgttttttctctataaaaaagtatggcgggtggggtgagcttgaagcacattttagaacaattagcggaggagcggctgggctttctggttaacgggcatgctatgagacaggagtctcaagtcggagaccttaaagtcatggagcgtaagaaaaagcttctggaaaaacgtaaagttgacatcataaaagcgaaagcaaaggccgtgattaatcatgtgcgggttgaggatgacggaacgacctgcctttcgtataccatccattacgaatacgtgtgtaaggaacaagatgacagcttgtatatagaagagcacatagaggagcgaatggctttcctgtatgatcacattttgattagtgatcaggaaattgcgaaaaagccggctggatttcatgaagggaccagtattattgactattctgaagctgaagaggaaagagaagcgtttggcagggcttttcaatacgatcgtctcggcgctgtccaatatgccgagaaattttggaacaagcgcaatcctgcttataaaaatttcagcgataactgtacaaattttatttctcagtgtcttcatgcaggaggcgcgccgatgcgcggtcatccgaacaggggatcaggctggtggatgaaacaaagctcatggagctacagctggacggtggctcactctatgaaaatgtatttgtcgaattcaaaggccggactgcgtgcggtgcgggtgaaatcagcggaagaactgatgccgggcgatgtgatttgctatgacttcgaaggagacggccggtttaatcatacaacgattgtcgtggcaaaggacaaaggcaatatgccgcttgtcaacgcccagacttatgacagcaggatgaggtattggtcatatgaggattctacggcatacacgccgtcaatacgatatgccttttttcatatcgttgatgatacgacaaaagagtaattaatgttataatgatgggcggataagaaaaacagaggtgaacattgtggcattacatgtcgttttatatcaaccagaaattcccgctaacacagggaatattgcacgtacttgtgcagcaaccaatacaacgctacacctgattcgtccgctcggcttttcaactgatgataaaatgctgaagcgtgccggactagattattgggagtttgttaacgttgtgtatcatgattcgttagaagaattgtttgaggcatataaaaaaggcaagtttttctttattacaaaatttggccagcagcctcatacatcatttgattacactgatcttgacgaggattatttcttcgtgttcggaagagaaacaagcggtttgccaaaggatttaattcaaaataatatggaccgctgcctgcgtcttccgatgacagagcatgtcagatcgttaaatctgtccaatactgccgcgattcttgtttatgaagcgctgcgccagcaaaattaccgtgatttaaaatagtgaaaaacccgctcatcgatgatgggcgggtttttttgcggatgttgaaatgctttgtttcgtttttgggcttaacaacgtaacagtgttatgttacaatgtacccatcaaaggagctggacttatggaagaacaattaatctctaaaaaagaattacttgaaagaacatcgatttcatacggtcagctgtatcgatggaagcggaaaaacttaatacctgaggaatggtttattcgtaaatccacatttacagggcaagagacgttttttccgagagaggagattttaaaacgtatatcaatgattcaaaagatgaaagaaaatttgtctttggatgaaatgagggaaatgctgtcgccgaaaatgaaggatgtcagcatgaccgctgatgaattgcttcataaaggtttggtttcaaggcctgctcttgaagcctattcagaagacggaggaagtccggttttttcatccagcgatttgctttcgctgtttgtgcttgagggcctgctgcagtctggaaatgtcagccttgcagaagcaaaaatggctgcagaggtattaaagaagcatgatactgaagagattgaaaaacagacggagctgattgtgctccgcaagctcggtgtcacaacttgttttatagcggctgcggcggacagcattttgtttgaatcatccgtaaaggttgtggaacgggtagatttattaaaagcttcagaggaattaaaaacaacatttatgcaggagggccatcaatggatgtagtggaaaagctggtgataaatggatcaggaagttctaagggaggaacatttcaatcagttgagattaatggcagcgggacagtggccggggacgtggagtgtgacactttttcttttaatggaaacggaaaagcggacggcagcgtcaaagcgaaagcggtaactatcagcggttcaggaaagatacatggagacgttgaagcagaatctatccggatgaatggcactggttttattcaaggagaggtatctgcaaaacaattgaaaatcgctggatcatcaacatttggcggcactgtcaaggctgatggaattgacattagcggaaaagctgtcatggaagcagattgtgaaacagaaacctttcaatcagaagggaaatgcaaaatcagcgggcttttaaatgcagaccaggtgatcattaagctttctgcaggggaaagctatgcgcgggagatcggctgccgccatcttcaagtgacctgcagaaaaggaatgctgaatttgctcagattgatgccgcagcctgttctaacagcagagctgatcgaaggtgacgtgattgaattgacaaatacaaaggcgaaaaccgtgcgcggtaataaagtgatcatcggcccggattgccagattgaaactgtcgaatacagcggggactatacctgtgatccaagcgcgtcagttaaaacatccacaaagttgtaaggaggatcgtaatggagacaacaaaactgggaaatttaaaattatatggcgctgggcatgccgcaggaggcgcgtatcacaatgtcagcatcaaaggagaaggtatagttggagaagggctgtctgctgtaggctgccgcatatacggaacgggcctttttctcggaaaagcagagactgagcggctgcgtgtgctcggagaaagtgaatgtaaaggcgatctgacagccggcaaaatcaatatatatgggataatgaaagtcagcggctcacttcaatttgatcgattcaatctgaaaggccagactgaaattggcgggaatatgactggagaatcctgcgatgtgaaagggaagcttagcgtaaaaggtgattgtgaaacagaaatgttccatgtcacaggctgtgttgatgtatcggggttattaaattcgggtgagatcaagctgggattgagccatgatataagccatgtgcaggaaatcggcggaacaacaattacagtgaaaagacgcgcgagtttttttaaccggaagaaagtgaagctgatcgccgatgtcatagaaggcgatcgggtttatttggagaataccgaagcggcagtcgtcaggggaaaagaagtgatcatcgggccgggatgcagtatcggaacaattgagtacgaaaacaaatatgaatgcgatccgcattcacagattaaagaaaaaacaaaactgtaaaacattgttctgttatacaaaaagggtgctctttcaggagcacccttttttattcttttccaggcttgctttcgtatcctgcggtaaaaattgatactaaaaaagtgacaatgacacccatcatgatgattgttttcaccgtctctccccctcttcaatttttccgtgctgtccgagtctggatgattctgtatttttctttattatgaacggtcgcggtctgccttgtcaacgatgtataagtatctttatttttaagaaaccaaagcatgtatcacgggatggcggcatagattgtatcaaagtaccttatttgcatagtgtatcaaacatgatagaggaggtccttatggatatattaaagaaaattgaaaagtacagagaggaagagcagcggctgaaatgggaaggaactttcgccgattatttggagattattaaagaaaatccgatggtcgcgcaatctgctcattctcgagtttttaatatgataaaagacagcgggatagaggagattgacggacgcaagaagtacagtttttttgaccgcgagctgttcgggcttgaagaatctctggagcgtcttgtggaagagtattttcatccggctgccaaacgtctagatgtcagaaagcggattctattgctgatggggcctgtgagcggcggtaaatccacgctggtcacaatgcttaaaaaaggtctcgaagcgtacacgctgacagataatggcgctgtatatgcgattaaaggctgcccgatgcacgaggaccctctacatttaatcccccatcatttacgcgatgacttttacagggaatacggcattagaatagaaggaagtctttctcctttaaatgtcatgaggctggaggaagagtacggaggaagaattgaggatgtgaaggtggagcgcatcttcttttcagaagataagcgtacgggaattggaacattcagtccctctgatccgaaatctcaggatattgccgatttgacggggagtattgatttctcaacaatcgccgagtacggttcagaatcagatccgcgtgcttaccggtttgacggagagctgaataaagcgaaccgcgggatgatggagtttcaggagatgctgaaatgtgatgagaaatttctctggcatttgctttccttgacacaggaagggaattttaaagctgggcggtttgcgttaatttctgctgatgagctgatcgtggctcacacgaatgaaacggagtatcgctcatttatttctaataaaaagaatgaagccctgcactcaagaatcatcgtgatgccggttccttataatttaaaagtgtctgaggaagagagaatttatgaaaaaatgattgcagaaagcgatgtggcggatgttcatattgccccgcatacgttgaaggtcgccgcgatgttctcaatccttacccggttaaaagagccgaagcggtcggatattgatctggtcaagaaaatgagactgtatgatggagaaagtgtggaaggatataattctgtcgacgttgaggatatgaaaaaagaatataatgatgaaggcatgagcggcattgatccgcggtacgtgatcaaccggatttcttcaacgattatcagaaaaaatatggaatcgattaattctctcgatgtccttcgttccttaaaagaaggtcttgatcagcacccatcaatttcaagcgaggacagggagcggtatttgaattttatttctgccgcccgcaaggaatatgacgacattgcgaaaaaggaagttcaaaaagcgtttgtgtattcatatgaagaatcagcaaaaacacttatggacaattacctcgataacgtagaggcttattgcaataaaaacaagcttcgtgatcctttgacaggagaggaaatgaaccctgacgaaaagctgatgagatccatcgaagagcagatcggcatttcggaaaacgccaaaaaagcgttccgcgaagaaattttaatccgcatctcagcctatgcgagaaaaggcaagcggtttgattacaattcccatgaaagactgcgtgaagctattcagaaaaagctgtttgctgatctgaaggatgtcgttaaaattacgacctcaacaaaaacgccggatgagcagcagctgaaaaaggtaaatgaagtcgtggcccgtttaattgatgagcacggctacaactcgacgagcgccaatgagctgctgaaatatgtcggcagcctgctgaaccgataagcaacgtgacccgtccgaatagggcgggttattttgtccaattttctaaatagtttgtcaattaaacatgcatatgtgcatatgatgaatataaatcttttcaaaagacttgtttcataatctggcacaagccggaatacgtatgtatcacgaccacaaatggttaaggaggggaattcatgtcccaaaatgacagcggccattttttgatttctgaggaaaactggtccctccatcgcaaaggcttcgatgaccagcagcgccaccagaaaaaagtgcaggaagcgatcaaaaacaatcttccggacctcgtaactgaggaaagcattattatgtctaatggaaaagatgtagtgaagatcccaatccgttcacttgatgagtataaaatccgttataactatgataaaaataaacatgtagggcaaggagacggcgagagccaggttggagatgttgtggcccgggatggatcagacaaaaaacaagggcctggaaaagggcagggtgccggtgatcaggcaggcgaggattattatgaagcggaagtttcattaatggatttagaagaagcgctttttaaagaattagagcttccgaatctccagcaaaaagagcgggacaatatcattcatacagatatcgagtttaatgatatccgtaaaacagggttaaccggtaatattgataagaaaagaacgatgatgtcagcctttaaacgaaacgcaatgtcaggaaaaccgtcgttctacccaatttatccggaggacctgaaatataagacgtggaatgacatcacaaagcccgaatcaaaagccgtcgttttagccatgatggatacaagcggcagtatgggggtttgggaaaaatacatggccagaagcttctttttctggatgacccgttttttgcggacaaaatacgagactgtggaaattgaatttattgcccatcatacagaagcaagagtggtctcggaggaggattttttctcaaagggagaaagcggcggaaccatttgttcttccgtatatcggaagtcgcttgagcttattgatgaaaagtacaatcccgcccgctataacatttatccgtttcatttttctgacggtgacaacctgacatctgataacgcgcgctgtgtgaagctggtcaatgatattatgaagaaggccaatctgttttgctacggcgaggtcaatcagtacaacaggcattcaacgttaatgtctgcatataaaaatgtaaaagatgagaaatttaagtactatattttaaaacagaaatctgatgtttttcaggctctaaagaactttttcagaaatgaagagtctggtgtaagccatcaattttcgtaatgaaaagcccatttcagggctttttttatttaataaaagcaagaaaacgcttgcgaaaaaaatacgggagaaaaagaaatttttcctttgacaaatcttctttcatttattaatattttatcttgtgaactattattgaggaatgaggtgaaaaggagttgactgaatcagaacgtgctttgctcacttttgaacagctcttcgatacgtctcgggcgatatataaaaaacagaagaagatattggagattgtgcttgagccttttgatattacagtccttcaatatttgctgatgtttaaaattcatcaaagcggaagcaccccgctaagcaagctggcaatgtcgcttgatcttaagcctgcttctgtgacgcggatgacagatattctgtataagcgccaattgatgaatcgatatgacagtccggatgaccgccgtatcgtcatgattcagttaaccgaagagggggaagaactgatagaaaaagccgctgtgcaatatgcaaaaatgggtgctggcttgtaccaaaagcttgatacctcccaactgcagtatttgcgcaaactagccggaagcttaacgaagcttgctgaaggctgttcagaaaaaagcggtaattaaaaacttctcacatattttcaccagctttccgcaaaatgatagaggatgaaacgaaaggagaaaacaaaatgaacagaggacgtttaattctgaccaacattatcggtttgattgttgttcttgcaattatagctggaggtgcttactactattatcaaagcacaaactacgtaaaaacagatgaagcaaaagtagcgggcgatatggctgctattactgctccagcagcaggtaaagtatctgactgggatctggatgaaggaaaaacagtgaaaaaaggcgacacagttgcaaaaatcaaaggcgaacaaactgttgacgtaaaatccattatggatggaacaattgtgaaaaacgaagtgaaaaacggacaaaccgtacaagctggtacaacaattgcacaaacgattgacatggacaacctatacatcacagcaaatattaaagaaacagatattgcggatattgaagtaggaaatagtgtagacgttgtagttgacggagaccctgatacaacatttgacggtactgtggaagaaattggctatgcgactaactcaacttttgatatgcttccttctacaaattcaagcggaaactacacaaaagtaacacaaaaaattcctgtgaaaatttcaatcaaaaacccatctgataaggtgcttcctggaatgaatgcatctgttaaaatttctgagtaaaacagatcagtcatcaaaccatgaaaggaggttgtcttagatggctacaggcaaagaaaaaaatacaaaaagccctatgacattgctgattgtgctaatggcgggtttatttttggcaattctaaaccaaacactgcttaatgttgcaatgccgcacttaatgactgaatttggcgtaagtgcaacgacgattcagtggctgacaacaggttacatgcttgttaacggtgtattgattccgttatctgctttcctgattacacgatttggccagcggagtctctttctcgtcgcgatgttttgttttacgctcggtacgttagtctgcggtatcgcacctaacttctctacaatgctgatcggccgtttgattcaggccgtgggcggaggtatcttgcagccgctcgttatgacaaccattctgttaattttcccacctgaaagcagggggaaaggaatggggattttcgggctagcgatgatgtttgctccagcggtcggcccgactctttccgggtggattattgagcattatacatggcgcattatgttttacggacttgtgccggtcggcgcaattgttatcatcgtggctttcttcatttttaagaatttggtagagccgcaaaaaatcaaactcgatacactgggagcgatcctctcgattgtcggattcgcctccttattatacggagtcagtgaagccgggtctgacggctggaccgacccgattgtattgtctacagttattatcggagccattgcaattgttgcttttgttgttcagcaattgcgtcatgatgatccgatgcttgatttcagagtgtttaaatatgacattttctcactctcgagtgtcattaatatcattataacagtggcactttacactggtatgttccttttaccgatctatctgcaaaacctggtcggctttacggcgcttcaatccggtctgcttctgcttccgggtgcgatcgttatgctgattatgtcaccgatctcaggtattttgttcgataaattcggaccgagaccgcttgcgattatcgggcttctcgtgacagtggtaacaacatatcaatacacgcaattgacaattgatacaccatatacacacatcatgctgatctattcaattcgtgcatttggtatgtctctcttaatgatgccagtcatgacagccgggatgaaccagcttcctgcccgtctgaacagccacggaacggcgatgagcaacacgcttcgccaaatcagcggatcaatcggaacaagtttaattacgacgatttatacaaaccggacgacattccattattcacaaattgcagataaaacaagcacggcggacccgaacttcctccatgcgttccaaaatgcagtttcgaatttaatggtaaatatgaatgtgtcttatgatacggcgaaaacatatgtgtactcacatatttataaacacgcgtcactcgattctaatgtcatggggataaatgatgcctttatgtgggcaaccttattctgtgtagcaggtttgattttaagtatcttcctgcgtgacgtcagaaaagataaattgcgtaagaagaaaaaagaggagctttcattacttcctgctccaaaagaagctaaggaatcttaatctgtacagggaggtttcctgaatgaaaatttatgtagtgtatgatagtgaaggcgaacatactaaagtgcttgcagaagcaattgctgaaggcgcgcgagaaaacgacgcggctgaagtgttcatcgaccatgtagatcaggctgatatccgcaagcttaaagatatggatgcgattatttggggatgcccagggcatttcggaacaatcagctccggtcttaaaacttggatcgacagacttggctacttgtgggctgaaggcgagctgatcaacaaagtgggtgctgtcttctgcacaacggcaacaacacacggcggcttggaaatgacaatgcacaatttaatcacgccgatgttccaccaaggcatgattgttgtcggactgcctggcaacgtgcctgaaaacgcactttatggctcttattacggagcaggtgtcacttgtccggtagacagtgatgagttaatgtctgaggaaggtattcagcttggacgcgcgttgggaagacgtgtcagccaagttacaggaaacctaacagcaggacagtaaggagaggttgaaatggccattattatagcaataattgctgctgtcattgtcattgcggcccttattacatttaacgtccgcaacgcctcacctggacctgagaagcaagaagcaactgatagaatcgcacctccagaagaggaaaaaaacgaagcgcattaccctgctgaagcaagggctgccgagcatacgccatccgttgtcaaaaacgattctccaaaagagaagcgtgacacaatgggtgatgatatttacaggcaggcgctgcaaaagtttaagcattctgatgaagttcatgcagaagaagaggtcactgaggaaagtgacaaaatgcaggaccgcagctatcgtgatgcgctgctctctatgaaaaataagaaaaagtaatgaaaaaggcaaatccgtttactcatgcgggtttgccttttttgctgtttccatcaattatgtttttatcaaataaatccatggaatatgttgtattccatcttgatctagtgtactatgttactcatacaccgaggattttttccgggaggtaaagacatgaattcttttttaggtttattaaagaaagatatcaagctttcaagaatgtggctgctattatggatatgcggaatcattttcttattgggaacaggccatattatagcttctcgcacgaaagaacctctagtcatttttggtttttttgttgcagttgctttttttctgcttttcttatctcctgtttttgttttttatcaccttcgcaaggaagggaaatcacagctttggctgtacaatccaaatggcggcttatggctgttttcttctaaattggcagcatctttgctctatcaatttgtgattcagttggcattaacagcctatggcatatggatgtatcatatgctctctgtaaaaaatctgctggagcatcaagttgatataacgagtacagtggctttgctgaatatgtatgggcttatttcttcgttagatatgtcagtaacagtcattgtattttggactgtttttcactctctcagaaattggcgcggaatgcggtgggctgcgatggttctgttggtcgcagtgtggttattcttcgatgaatacatcataagccctttggttgaatctcaaaagcatttctggcctgtaacagtctattgcaattttgatttccacttccacaatgtttggagattggaactaaaacctatccatctgtctgtgctagggtttcctattgctatagtcatcacgttcttgctgctcattatggcttcaaaactgcttgatcgtaaagtagaggtgtaaatatggacaatcaattccaatcctcgaaaccgatttatctgcagatcgctgatcagatcttttataggctggtcaggaaggagctgctcccaggagacaagcttccttcagtaagagaaatggcgattcaaactaaggtaaatcccaatacaattcaaagaacgtacagtgagatggaaaggctgggtattgtggagacaagaagaggtcaagggacgtttattgcggaaaaagcagaaatcgtagacgagctgaaagacaagctgacacgagaggtgctggaaggctttgtcaagcaaatgaaagagctggggctaacgaaagaggaaatgttagaagggattaaaacattcacagagggaggctaaaatggaaatcaagctagaacatgtatcaaaaaaatacggccgccatacggccgtcaatgatgtgtcaatcaccctatcatccggacggatttatggcctgatcggaccgaacggcagcggcaagtcaacgaccctgaaaatgatggctggccttctgtttccgacttcaggatttgtgaaaattgatgaagaacaggttacgagagaaatggtgcgtcaaacggcttatcttactgagcttgatatgttttatccgcatttcactgttaaagatatggtgaatttttatcagtcgcagtttcctgattttcaaacagaacaggcttataagctattgaatgagatgcagctgaatccggaaaaaaagatcaaaaagctatcaaaaggaaatcggggccggctgaaaatcgttcttgctttagcgagacgggcagacgtcatcttgcttgatgaacctttttccgggcttgatccgatggtcagggattccatcgtaaacagccttgtgtcgtacattgattttgagcagcagattgtcgtgatcgcgacacatgaaattgatgaaattgagactttgttagacgaagtaatcatcctcgccaatggggaaaaagttgcgcagcgtgaagtagaagatattcgtgaacaggaaggcatgtctgtgttgcaatggtttaaatcaaaaatggaagtttgctagaaagaggaggaatatgatgaaaacagtgttggaattgaaaaacgtgactaaaaacatcagaggccgaacgatcattgatgatctcagttttacgattcgtgaaggcgaggtattcggttttttgggaccaaacggagcggggaaaacgacaaccatccggatgatggtggggttaatgaagctgtcgaaaggtgatgtcctcatttgcggccaatcaattacgaaagaatatggcaaggcgattaagcatattggagcgatcgttgagaatcccgagctgtataaatttttgagcggatataaaaatctccagcaatacgcaaggatggtcaagggtgtcacgaaggaaaaaattgatgaagttgttgaactggtcggtttaacagacagaatccacgacaaggtgaaaacatattctctggggatgagacagcgtcttggcttggcacaatgccttctgcacgatccgaaagtgctgattttggatgaaccgacaaacggccttgatccggcggggatcagagaaatcagagatcatttaaagaagctgacccgagaaagaggaatggctgtcatcgtttcaagccacctgctgtcagaaatggaactgatgtgtgatcgaattgcgattctgcaaaaaggaaagctgatcgatattcaaaatgtaaaagatgaaaacattgatgagaacgatacatatttcttccaggttgagcagccgaatgaagccgctgctgttttaaatcagtacgatttgctgagtaagacaaatggtgtagaaatcaaactggctaaagacgaagtccctgcggttattgaattgctggtgatgcagcaaatccgtatttatgaggtcaaggtcataacaaaatcattagaggaccgtttcttagaaatgacaggtgaaacaaaagaggaggttcagcatgcttaatttgatttataatgagtggctcaaaattttcagccgtgccggaacatgggtgatgatcggaattctggggctgacaatggttggattttcatttttggcgaatcatttttctgctggtgaatcaaattcccattggaaacaagaacttcaagcacaaaacgccgaattaaagaaagaaatcaaagaagatccttcactgaaagatgggtataaagaaacaatcacactcaacgactatcgcatcgagcataatatccctagtgacacgggctatacggtatggtcttatgtaacggattcagcaaactttaccatccttaccggtctgtttactattatcatcgcggccggaattgtcgcgaacgaatttaattggggaacgattaagctattaatgattcggccgctcagccgttttcaaattttgatgtccaaatatattacagttctcctgtttgggctcctgttgctgttgattttatttatcggttctactttattagggttgatcttcttcgggacgggtggtgaaaccgccgcgaatattcatttaatctataaggatggccatgtcattgagcaaaacatgatggggcatttggccacaacgtatctttctgaatccgtctcggctttaatggtggcgacgatggcatttatgctgtctgcggtattcagaaacagctctcttgcggttggtttttccatcttcttgttggttgccggtacgactgcaactgcatttattgcagcgaaatttgactgggcaaagtatatattgtttgctaatgtcgacttgactcagtatgtggatggcacaccgttaataaaagggatgactatgacgttttctatcgtcatgctggcgatctactttatcatcttcttgttgcttgctttcggaatcttcatgaagcgggatattgcaaactaataaagaaagctgttttgcataagcaaaacagcttttttgtcaaaataaaaactgcaggtttgcacctgcagtttttcatatcaatttatgcttacgcttctttagtaacgttagcagcttgtggtccgcggtttccttcaacgatttcaaaagaaacagcttggccttcttctaaagttttgaagccttcgccttgaatagcagagaaatgaacgaatacatcgtcttgaccttctacttcgatgaatccgaaacctttttcagagttgaaccattttactttaccttctaacatgaaatttcctcctaaagcgatcataacgcttaaattcactattcttgctcttaacaaactttcaagacgaaaactcttacaaaactttcttcttaaagatagttcgaacaaaaataattacctttactctaccagtaatcttcggaaaaaacaactgcttattgaaacttttttcggaaaataccatatttatttttcaatttgatatttatttgcggaaattcatctgctttctcgatatgtgatcatacgtttgccttagtattccttcattttgggaagataagtaataggaattgacaaccttattggatatgagtaaggtaaaagttaatcaatattacaaatgacaacgtttatcaactaagagagcgtatgatttttatgtctgatattgcttgcatgctctaatacatagataggagtatggtcacaatgaaaaagtggcttatatgcagtttcgtccttgttcttctcgtttcatttactgcatgttcaccgtctgcagaacatgaatcgataaaaatcgggattgctgagtctgacggggcaatatggaactatattgctcaaaaggctgaagaggcagggctggatattcagctgatccctttttctgattatgcggagtctgatatcgcacttgctaacaaagaaattgatgccaacgcctttcaaaccatttcatattttcagtcgttcactcaaaaatacaaacttaatttggcaccgctcggaacgacatacataacgcccatgggcatttattcaaaacgatatgaccgaatccgagatataccgcgaggagctgtcgtttctgttccggatagagcgttcgattttggcagggcgcttacggtgctccaggaagcgggtttgctaacgctgaaaaacggatttaacggaacaggttcagttgatatgattaaagataatccgagacacctgaaattaaaagctgtccggcaacaggatgcagtgagcggtgccgacgtgtttgtcatgaaaccatcagaagcaaaaaaagcgggcctgaacccgaaaaagcatacgctaaagagcggcggactcatgtctgaggaagagatgaatttgattgttgtcagagcggaggatcaagaccgggaagcgctgcaaaccattcttgagctttatcaagctgatgatacagcggcatttatagaaaaagaatatcagggagatcttgtcccggcttttctgcctttgaaacgtctttcagattggaagaatgaattcgaacattgaattcattcttttttttctgaaaaacacactctgttccgtcccgtttctttcgctttgtaaagcatttgatcggcaagaatgggcaaggatcctggctgttccgtattattggggtaatgagcggctcctagtgatatcgtaactgaaagctcttcgccgtttgttaatacaatcggtgcatcgcttacagcgctcctgatccgttcagcgattcgggctgctttatcaagagaacagttcggcaggagaacggcaaattcttcaccgccgatccgagcggcaggatctgtatttcggatgctctgcttcagacgtaaccccagctctttgagcacctgatctccttcatgatggccatattggtcattgatggtcttaaaatgatcgatatccatataaatcagtgcaaattgaaaatgcggggtatcggccgcctgctgatacagagcttttgtggtttcttcaaactttcttcggttatacacgcctgttaaaaagtcaaagtgcgcctgaaacttatattgtttaaaaagaagatgtgcatttgtttcatgatcaataatatataaactgagcatgccgcccgctattgatatgatccaaaaatacaaatgaagttcgtatgaatgtaaatctataagaaaataaaaggaaaaggagatcaagctatttgtgattattaaaagatagaaagcatgttttagttgaactttttttcttctagaaacaatgagtgacggaatggcagcgatacaaatgataataaccgagtatagtgcagatgtgttcatcgtaatcagcaagcggcctgcagtgatcatggccagggccgttgccgttgaaacccagcctccataaagagcggcaatcataatagggatatttcgaagatcaataattgaatgctgataggtaaatccaaaaaccatcagaataaccccgagcaaaccgcaggccagtcctttaacagcttgaaaggatatgctgtcttttttatgtactagcctttctttaaacaggtgggtgaagagataattaaatgtgattaaaatggtcaaatttacaaacagttctttcagcaaatattatcacccttatataaggtactaaagatggaagggaaagaaaagaacaaaaaaggcattatataaggtttttttacttgaattgacaagttaaaataattcgcacttgacccatcggaattagtgtaatatagtaaatgagaaaatttgaagggagagtttacctgctttggagactttactggttgtattacatgtatttattttatttttacttatcttagggctctttgttatgcagaaaaaacatgtttccttctctaaacgtgtatttactgcgctggggctggggattgtattcggatttgcgcttcagctgatttacggcccgacttcaaatatagtcattcaaacagccgactggtttaatattgccgggggcggatatgtcaaattgcttcagatggttgtcatgccgctcgtctttatttcgattctcggcgcatttacaaagctgaagctgacaaaaaatcttgggaaaatcagcggtttgattatcgggattttagtagcaacaacagctgttgctgcagctgtcggtatcgcgtccgcactttcatttgatctgcaggcgattcaggttgaccaaggaagtacagagctttcacggggacaggagcttcagcagaaatcagaggatatgacagcgaaaacgctgccgcagcagattgttgaactgctgcctggaaacccgtttttagatttcacgggagctagaccgacttcaacgatcgctgtcgttatttttgccgctttccttggagtggcattcctcggcgtaaaacacaaacagccggaacaggcagaaacatttaaaaaactggttgatgccgtttatgccattgttatgcgtgttgtcacactcattttgagactgacgccttatggggtgctggccatcatgacaaaaacaattgcaacgagtgatcttgacagcattttaaaactgggcatgttcgtgattgcttcatatgccgcgttaatcactatgtttatcattcatttgctgctgctgacgttcagcggcttgaatccggtgatttatttgaaaaaagcggtgcctgtacttgtatttgcatttacgtcaaggtctagcgcaggtgctttaccgctgaatattaaaacacagagaagcatgggtgtaccggagggaatcgcaaactttgccggttcatttggtctttcgatcggccaaaatggatgtgccggcatttatcctgcgatgctggcgatgatgattgctccgactgtcggccaaaatccatttgacccggtgtttattatcactgttatcgcagtcgttgccatcagctccttcggtgttgccggagtcggcggcggagcgacattcgcggcgcttcttgttttatcatcattaaacatgcctgtcgcgctcgcaggtttattaatctcaattgaaccgttaatcgacatggggcgtactgctttgaatgtcagcggaagcatgacatccggtcttattacaagtaaggtcacaaaggaaattgatcaaggggcatttcatgatcaatccagagtgattgaagctgaagaagcgtaacatatgaaaacgtgtaatccgacaggattacacgttaataagacccatgaaccttgtaatataaaggtttcatgggtttctttttctcatttttggggaagatcagccggcattgctgatcaatggattgatttaattgaaatgaaaattgcttttttaacgagtattcatggtatcttggaagacgctaactaatctgaggcacacataaaagattcctgctagaagatgagtatccaaatctaattcaatcgtgcttcattgaattaaaaaagttcataatgaacctcttcgcattatttttctattaacattgaatactttcgatacactttatagaaactggccgcaaataaaacaaccataagggcgggaagcgacctcaaaagagcaaatggagtttcaaataaaaatgctttccaaaaccattcacctttcatactccaaagaccttcagttaaatataaacctgaatccttatagatcatataagaaaaaaacaaacacatgaaacctaaaccagaagaataattcatcaatcttttataataattactctttgattggcgatccgagaagatttcattttgaccatcatcttctttttgccaatatcgaatcccactaagccaagggccatttatataattccaaccgaagtcttcatatatccctttgtaatctttgaactttttctttggtaaaatatcttggtaatccagtctgatcacatatctcttgtcggtttttacgaaagtgtatattcctaatccactaatatttgtacaacgatagcctttttgtaattgctcgttcagccattgttcctctttttcaatatcaaaaaacatcttaaatttcttcattcgattcacttccttcgtacaaggataaaatatgcaataacctatcttgttccatttttaaaatggcgcttccttcttcagttatcatgtaaacttttctccggcctgactctccaacaggttcaatccaaccatgcttattcaagttttcaattgcaccgtataatgtacccgctgctaaaataacagtaccgttacttatcttttctatcttctgcattacggcatagccatggagcggctcacgcagagctaataaaatataatgcatggtttcagacaatggtaataatttgtgtttcatatccgcaccctctattcagttcgactatatagttcaacttaataataatgtaatacagttcaactgaatagtcaatagcattttacaacgctcgagtaaattctaaatgttgagtgttgaagcaagaaacaaaatgaatagtgttctgtccttttcagcttgatgagggagctaataatgaatcgataaagattgcttcggatagagtggcagcataaacaaaaaaatccttcaaacgttctcattgaacgaaagaaggatttttttagctcatcaattgcactcaaaaacaggcggggaaatatagaaaatttaaaagaaaaaaccaccttaaagggcaatataattaactatttgagcccttatgcaatccgacaggttacacgtttttttaacggccgggttctaagtcctccagcatttccatcatcgtgttgtcgtccatgacattcattgcgctttgttcaaaatggatgggttcagcataatgcggctgtctttttttcgcggctgtctcagtttgcctagtttgagactgtgtatgctgatgctgtggttgctgctgttctgcgtgctggtgctgacggccattttgccgctggctttgatgctgcgaacggtcctggttatcaccgctgccgccgccaaatgcttgtttgactatgtttcctacattagaagcatcaaacgtgttattttctgaatttcgtctgttcatttgtcctgtgataaacccgctgattctgtggcggatctgaggtgataatgcagcaataagcatagttgatcctatgatcaatgctgtggggctgattcctcttcgctggttgaacaacatgatccctcctttgcaatgtattcatattttccccctcattagacaaattaaccgttatatttcccgggaaagcatttcctccagatttgcatgcataattaaagccagttagaaaaacctatacgtaaagtgataaaggaggaattcacatgcttggaaaaaaacaagttcttgcgtctgtgcttcttatccctttgcttatgactggctgcggtgtggccgaccaaggtgagggcagacgtgataataatgatgtaagaaatgtaaattatcgaaatccggccaatgacgatatgcgcaatgtaaacaaccgggataatgttgacaacaatgttactgataatgtcaataacaataacaatcgtgtaaatgacgataataacaacaaccggaaactcgaggttgctgatgaagcagctgataaagtaacagacctaaaagaagtaaaacatgccgatgtcattgttgctggaaatcaagcttacgttgcagtcgttttaactaatggaaataaaggtgcagtagaagacaatttgaagaaaaaaatagcccaaaaggtaagatctactgacaaaaacattgataatgtttacgtttcagctaaccctgattttgtagagcgtatgcaaggatatggaaaacgtattcaaaatggtgacccaatcgccggattatttgatgaatttacacaaactgtacagcgcgtattccctaacgctgaataaataaaaaaagccgcacaatttgtgcggctttttctttgcgttaatgacacactgcgaactcaggctgcatagagtaaaaataaaaaggtacaagacggaccggctcagggagggagacgtttgcgggatggcataggaaagcgtgcggcatccgctctattcctgtgcggagtccttgtgatgctggctgtaagctcagccatcgtatcaagcgcgatgtatatcctgtcttttccaggtcaggcatctggaataacaaaagaccaagtgacgaagcacatgaagaaagagtcattcaaacaggccgatatttattacacttctaaggaaaagtccttactgccattgacgaaagaaacgcttaaatatgcggtcagtattaatcagattatgattggatattcgaatcaaaagcctattgacattattttttttcctaatgaaaaacagatggaggcttactccggtttattggatgtagtcggtttttattctgagcgggagcagttgattggactgttgcctgaagagaaaaagaaactgttagaaggggacgaggtagcggtttatttgtaccagagattgttgattcatgaatactcgcaccatgcgtttcatcagaaattgaaggagcttgagacggatcccgatgagtttccgttatggtttcatgaagggttaagcgagtggattgcgaactatgaattgctcatagatccgatcacgttttctgtcgtgccctttgaccgtttgcagactgatcgagactggcaggaagccagagccgaatatgacactgatgtctatttgcaaagcttttatatgatcgatgagctgaccggcaaatatgggaaagacattatttcagaaatgattaaggaaacagcaaaaaaaggggactttgaaaaagggtttaaatcagcaacaaaggaaagtcttgatcattttgaaaaggattttaagaagaaatttgaaaaaaacagtgcggcattggatagtatctatccaatgcctttgttattagtgaagtccttgctgacccattccgccttgtgtcggaggcatttgtccttgggcaggggcgaatgaatttctcagctgttccatatcctgcgcatcaagctgaggaacctggtaatagccgtgtttgttttggtataggaaaatttcaaatgccatttcaacatactcctgaatttgcgcagacagtacgcgtcttacggccggatttgtcatttccagagaagccatcgtcagcatagaagcttgtgctttaatcgcgcaaagcatttgtcggctgatgatgctgtcatcaatatcattcatggattgaacaggttttttaggctgtgacggctgcatgccgtaaacagtctggttgtcttccttcatcatataagttgctgttttttgtgaaggttcgcttcctgttttgaagcattctgcagttatattgtattgagatgtgatgaattgatgttgacgatcaaggatgtttagtaattcttgatccttacagaattgtctcagcatcataaactgatcaagcacagtaagtgttccggaaagcacctcatgcatatcaaacatttcatgtccgccatggtttttatgcggtttgccaggaatacctttgttcatttgggattgctgctgctgattgaactgatccaaaccgaattcctccttttttttcagatcagctgtattttgtgtcagtctgccgtgtattatgcagaagcctgaaaggaattatatgctgtctgtcgaaatgataagcagacaaaatcgttgtcattatgtgtataagggaggaaatatgatgaggcgtattctgcatattgtgttgttcacggcattaatgttcttaaatgtaatgtacacgttcgaagctgtaaaggcagctgaaccgcaacagcctatatcgattgagaaggcaatacagcaaaaagaaggacaggcgcttatcgaaggatatgcagtcggccaggctgtttccccgcagcattataagctgacaagtcctttttcaaatgattataatgtcgcgctggcagaccgtaaaaacgagacatcgcctgatcacatccttcctgtgcaaatcccctccgccttcagaagccaatttgggctgcaaaccaatccgcttcttcttgggaaaaagataacggttcaaggaaagcttgaaaattactttaacacgacaggacttaaaaacgttcagtcgatgaacgtaaccgatgacacgaaaactccgccggctgaacagccagtgaccataaatgaagcccggggaaggctgaatgaagaagtaacgataaaagggatcattaaagctgatcaaaacgcaatcggaggcgggaagctgtcgacctttttgcaagatgaaaccggaggcattaacatttattcgccatcccctgaacaatttcccgaattaaaagagggtatggatgtcacggtgacagggaaaatcgcgtcttaccaggggctgaaagaaatcgttccaagctcatcaggcatcaaaatcaaccagtcaaaccaatccctccccgcccccaaacacttaacaatcaatgaacttattaacggcagcctaggtgatcagtatgaaggacgccttgtaaaactaaccgcttttgtttcctcaattccaagttctcctgccggcggcggttacaatgtaacaatgattgatgacgaccatcatgcaatgacgctccgggttatgaatgaaacaggggtgataaacgagcttgatgagggcaaatggtatgactttaccggtgtgttaagcagataccaaacctttcagctgcttccgcgaaaatcggctgacctgaagctgcttgaagagcagcccgcacctccgtctgcggagggagaatatgaagggattgttgaccgggtcgttgacggcgataccattcatctcaaatctccggtgcttggaacgacaaaaatccggtttgtaaatgtagatacacccgaaacatatcacacaccaaaaaatgacgcagatgaaaatcaattaagatttggcaaaaaagcatctgactatctaaaaacggttctgtccccaggtgataaaattactgtcaaggtcggaagtgaagccaaggacagctatggcagacttctcggacaagtcataaccgaatcaggatcaaacgtgaacttagagcttgtgaaaaatggatatgctccgacgtattttatttggccggttgacaatgaagaggattaccagcagtttcaggccgcagtagccgctgcaaaaaaagaccaaaaaggaatctggaatgaaaacgacccgctcatggaaatgccgtttgaattcagagccagagagcaagggaaaggcttgacaagatatgtaggggattcgtcgaataaaacatatgtgaagccagctgactggaagaaggtagctgtggaaaacagaattttcttcgcttcagcaagtgaagcggagagcgcgggatataaaaaaaggcaaacggcacctcaagaacatgtgccgcttagaattctcagcatgaatgatttgcatggcaaaatcgatcagcaatatgagcttgatcttgatggaaatggaactgtagacggcacgtttggacgcatggattatgccgccgcatatttaaaagaaaaaaaggctgaaaagaaaaactcgctgattgtgcacgcaggagatatgatcggcggaagctctccagtttcctctcttcttcaggatgaaccgactgtagaactgatggaggacatcggatttgatgtcggaaccgtgggaaaccacgaatttgatgaaggcacggatgaactgctgaggatcttaaatggcggtgatcatccgaaaggcacaagcggatatgatggacagaactttccccttgtatgtgccaattgtaaaatgaaatcaactggagagccctttttgccggcttatgacatcataaatgtggagggcgtacccgttgcttttatcggagttgtcacacagtcggcagctggcatggttatgcctgaaggaataaaaaatatcgagtttacagatgaagcaacagcggtgaataaggcggccaaagagctgaagaaaaaaggcgtgaaggccatcgcggttctcgcacatatgtcagctgaacaaaacggcaacgccattaccggtgagtccgctgatcttgcaaacaaaacagattctgaaattgacgtgatttttgccgcgcataatcataaggttgttaacggtgaagtgaatggaaaactgattgttcaagcgtttgaatatggaaaagcgataggtgtcgttgatgtagagatcgataaaacgacaaaagacattgtcaaaaagtccgcggaaatcgtatatgttgatcaaagtaaaatcgaaccggatgtcagcgcatcagccattttaaagaaatacgaaacaattgcggaaccgattatcagcgaggtagtcggcgaagccgctgttgatatggaaggggggtattcaaatgacggcgatacacctcttggaaacctgattgcggatggtatgagaactgccatgaaaacggattttgcccttatgaatggcggcggcatacgtgaagcgctgaagaagggcccaattacgtggggagatctttacaatattcagccatttggaaatgtgttaacgaagcttgagattaaaggaaaagatttaagagagattatcaatgctcaaatctcgccggtttttgggcctgactacagcatcagcgggtttacgtatacgtgggataaagaaaccggaaaagcagttgatttaaaaatggcagatggcaccgagatccagcccgatgccacatatacattgactgtcaacaactttatggcgacggcgacagggaccaaatatcagccaatcggactgctgggaaaaaatccggtgacagggcctgaggatttggaagcgacagttgagtacgtgaaaagttttgatgagccaattgcgtatacaaaagagggaagaattaagcttgctgaagccagtgatattgaagaccctgtaacagaagaccctattacggaagagcctggagatgatccggtgacggaggatccgattaaagaggatccaaggccaggtgaagatttgcctgatataaaagaaactccgggaacagcaccggttcatcagctgccgccttcagccatttcgagattcaatgaaataccaatcaacaacacaaaaaacgctgatactgctaatagcatcagcacattgccgttacgaaacgagggcggggaaagcgggtctgagcatccgcttccagatacatcagcaaactactataactttatcgtaatcggtgcggcggtgacattgtcaggaacttatctatatgtcagaagaaaaaggagcgcctccagaacgtgaaaaaagttattccactattcatcattgctgccggcctattgatcgcaggctatggaggctttaaattgatcgatacgaatatgaaaacagaacagacattaaaagaagcaaaactggcggctgaaaagccgcaggaacttttggggacgaaaaatagcacagatcaagcaaagaacaaagcatcatttaagcctgagaccggccaagcgagcggcattttggaaataccgaaaatcaatgcagagcttccgatcgtggagggcactgatgctgatgatttagaaaaaggtgtcgggcattacaaggacagctattatcctgatgaaaacggacaaattgtgctgtcggggcatcgggataccgtgtttcgccggacgggagagctggaaaagggggatcggctccgcattctcctgtcatatggagaattcacatatgaaattgtaaaaacaaaaattgtcgataaggatgacacatctattatcacgctccagcatgaaaaggaagagctgattctgacgacctgttatccgttttcatacgtcggaaatgccccgaagcgctatattatatatggaaaacgagtgacttaaaaagccgaggcagtgcctgcggcttttcttcatgaaaaatatgtgcgacaaaggtttttcatatcagcagggaaaggggcttcagcaactatgagctcgtctgttatcgggtgaaccgcttgtactttattggcgtgcagtgcctgcctgtttagcagcttgctcccgcctccgtaaagcgagtctcctgtcaacggatggccgaggctcgccagatgaacacggatttggtgtgttctgcctgtttccagctctaattcaacgagcgacagccgttctttcgcattgctggccattaccttgaaatgagtgacggctgtttgcccgcctggtgaaacccggcgtcttgtcgggtgtgatcggtctctgccgattggtgaattaattgtcccttttttcgtccgtagcttaccttcagcgatggcggtatacgtacgcttcagcgtctttttctctaactgctggtctaagatggcgtgtgccaaacgatgcttggcaaaaacgatagcgccagatgtatcctgatcaagacgatggacgtggcgcaccttacatgtttcgccatttatctgataatgatacgcgatcaaattagccagtgtgccggtctgcccatcctcattcggatgcgtcgcgatgccagcgggtttattgacgatgagcatatgattgtcctcatataaaatatcaagctcgccatactccggaatgaccgaagatgcttcactttcctgaagatcaatgaacacacggtctcccttttttacaatcatattgtttaagacggattcgtgattgacctttatctgttgatgggacatccagtcttgtatcactggtttagaagctttgagcgctgttttgagtacggaaaacagccattggccgtcctgtttttcattgatgaggatctcaagccctctgcctttttggttcatgttaaatggctccttttcgaagcggaaggctgctgtttctcataggaaacacttaccttagctttcgcgtttttttctgtgctattcttgagtaagacttaggatattcgatggcaagaaaggtgattgacgtgagaattgtgaacgcagcaactgcagaacaggagagctttatcaaggagctgtctatggagctgatccatgatgtatttcctctttatttctccgaactggacattcagcgctttaaaaagaaaggcgttctgtctttaaataaccattattaccaaggaacattaaaagaagcatttcaaattatggcttgtctgcaaatgatacatattatcctgaccaagccttcgccgcactctgatttgagtgatcaggcgatttttgaaaaaaacagcaagatgctgaatgattttgggatttattttccgtttgctttttctgactttcaaaagaagactaacaaagcctttttcggtcaaagaaggctgatataatcatgtggcaagagcttttctatttttagaaaagctctttttgtatcagagaaatcatatcataaaacctttcctctaactccctttttaaacggctcgtgtctgaacatactaatgattgaaaggggtgctgacaatgagttcagttaaagatacaatgacaacgcaggtggcaaccgtttctccgaatcaaacgattcaggaagcggcttctctaatgaaacagcataacgtcggggcgatccccgttgtagagcaaggtgttttaaaaggaatgctgactgaccgtgacattgcattaagaactacagctcagggccgtgatggccagacacccgtttcagaagtgatgtcaacagaactcgtatcaggaaaccctaatatgagtctggaagacgcgtcgcagctgatggcccagcaccaaatccgccgccttcctattgtagatcaaaacaatctagtcgggatcgttgcgcttggagacctggcagtcaatcagatgtcgaacgagtctgcgggatcagcgctgacaaacatttctcaccaaaacattcattaataagaaagagcttgcagtgtgcaggctctttcttcacataaaaccttactttttgaaagcagacttgtttcggggtatagttgagtgtatacatatgtctcaattcggactaaaggagttgtacccagtgattaaagcgttaatttttgattttgacgggcttattctagatacagaaacacacgaatatgaggttcttcaggaaatatttgaagagcacggctcagtgctgccgctatctgtctgggggaaggtcatcggaactgctgcgggtttccggccatttgactatttagaagagcagatcgggaaaaagctgaaccatgaagagctcacacaattgagaagagagcggttcgccaaacgcatggaaacagaaaaagcgagacctggtgtcgaagcgtatttgaatgcggcaaaggatttaggcttaaaaataggccttgcctccagctctgattataaatgggtttccggccatttgaagcaaatcggcctgtttgatgattttgaagttattcaaacggctgatgatgtggaagaggtgaagccgaatcctgaactctatttattggcggcaaagaacctcggggtatcgccagcggaatgtctcgcgtttgaggattctgtcaatggttcgattgctgcgaaacgtgcaggcatgaagtgtgtcattgtcccgaataaagtaacgggtaccttgatgtttgaagactatgatcacaggcttgaatcaatggcggagatggagctcgccctattgcttgatcatctgaactcacaaaactagaaaggagcgagtaggttgtctgagaaattagatttgacccggtttgaaaagaaaatggttatccgcaatatcgaagagaaagacatcgacaagattatcgatcttcaaaaggactgctttccaggaatggagccttggaagcgggagcatttaatcagccatttggagcattttccagaagggcagttttgtgcagaattcgaaggtgaaattatcggttcgtgctcaagtctcctgattaactttgatgaatatgatgaccgtcatacatggcaggacattacagatgacggttatatcaccaaccataatcctgacggcttgaatatgtatggaattgaagtcatggtggacccgaagtacagacgaatgaagattggccaccgtttgtacgaggcgagaaaggacttagccagacgcttaaacctgaaaagcatcatcataggcggacggattccaaactatcacaaatatgcagaggaaatgacagcgagagagtatgttgaacaggtgacacgccaccaaatttacgatccggttctttcttttcagctgatgaacggctttacccttatgcgaattaacccgaactatctcccggatgatacagcttcgatcaagtatgcgacgttgatggaatggaataatgtggattatctaccgcagcagacaaaacgctattataaatcggcgttccctgttagaatttgtgtgatccaatacgaaatgaagaaaatttattcctttgaggaatttgcgaatcaagtagaatactatgtcgatgttgcttccgacgcaagatctgattttgcggtgttcccggaaatttttacaacccagctgatgtccttccttgaggaacggtcaccgagcttggcggtgcagagaattaccgagtatacagaagattacatcagcctgtttactgacttggctgtgaagtataacgtcaacattatcggcggatctcatttcgtcgaagaggaaggcaagatctataatatcgcttacctgttcagacgggacggaacgatcgagaagcaatacaaactccatattacgccgaatgaacgcaaatggtgggggatcagcgcaggagaccaagttcgcgtgtttgatacggactgcgggaaaatcgcgatccagatctgttatgacattgaatttcctgagcttgcccggattgcggctgataaaggagccaaaatcatctttacgccattttgtacagaagaccgtcaaggctatctgcgtgtcagatactgttcgcaggctagagcggttgaaaatcaaatttatacggttatctctggaacggtcggaaaccttccgcaaacggaaaacatggatatccaatacgcccagtcaggcatctttgccccgtctgattttgaattcgctcgtgacggcattgtcggcgaaacaaacccgaatattgaaatggtcgtcatcggcgatgttgacctggaaattctcagaagacagcgccaaaacggtacagtgcgccagctaaaagacagacggcgtgatatttttcatattcaatataaaaaataattcccaaaaaacccgcctgaattggcgggttttttaaaacaaaagcgtaattgtttaggtgctatctttaaaataaaagtaggtatagtggaggtgccttatggagtttctgtattttcgccatttcctatatcatacagaaaacggctaggcttcacattgctattgcaatggctgtccaagttgtttcgagtgcgacctttatcagtacgatgctgagcattgtcactttgcctgttttgctttggaagctgcatcctctttcttcttgagaaaggggatgttttattatttacgcggtttattgactctgacccggtctggctttatattgaaggcagggaaatcatcaccaagacatcacataaagagaaggtctgtttcaattgaattggcattatagggaacgctaatgaaatggagatgatggggatggaaaacattcagcaaaatcagggattaaagcaaaaagatgagcaatttgtgtggcatgccatgaagggagcgcatcaagcggacagcctgatagcccagaaggctgagggggcctgggtaaccgacatagacggacgccgctatttggatgcgatgtccggtttgtggtgcgtcaacattggttacggcagaaaggagcttgcggaggctgcctatgagcaactaaaggagctgccttactacccgttaacgcaaagtcacgcacccgcaatccaactggcggaaaagctgaatgaatggcttggcggcgattatgttatctttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgccggggtcattatggagcccatcattacaggcggaggcatcctaatgccgccggacggatatatgaagaaggtggaggacatttgccggcgccacggagcccttttgatttgcgatgaagtgatctgcgggtttggacggaccggcgagccgttcgggtttatgcactacggtgtgaagcctgatatcattacgatggcaaagggaatcacaagcgcgtatctgccattgtcagcgactgctgtgaaacgggacattttcgaagcgtatcagggggaagctccttatgaccgtttccgccacgtaaacacgttcggcggaagcccggctgcctgtgctttggcgttgaaaaacctgcaaattatggaggacgaacagttgattcagcgatcccgcgatcttggagcaaagcttttaggtgagcttcaagctctgagagaacacccggcagtcggggatgttagaggaaaagggctgctgatcggaatcgaactcgtcaaagacaaattgactaaagagccggctgatgccgccaaagtaaaccaagtggttgcggcgtgcaaagaaaaagggctgatcatcggcaaaaacggcgatacagtcgccggctacaacaatgtcatccagcttgcgccgccattttgcctgacagaagaggacctttcctttatcgtgaaaacggtgaaagaaagctttcaaacgatataatataaaagtgaattattaaaggagcacatgatgagttttcacaaccagccgatcttaccggctattcgcaatatgaagcaatttgatgagtttttgaacagttcgttctcttacggtgttattcttgatattcatctcggccagctgaagggcgtgatcaaagaagcgcaaaagcacggaaagaacatgatggtgcacgtcgatctcattcaagggattaagcatgacgaatacggtgcggaatttatatgccaggatatcaagcccgctgggattatttccacaagatcgaatgtgattgccaaagcgaagcagaagaaaatttatgccattcagcgcctgtttttgcttgatacaagcgcgatggagaaaagcatggagtttatcggcaagcataagcctgacttcatcgaagtgcttcccggcatcgttccgtcactcattcaggaaataaaagagaaaacagggattcccatctttgccgggggtttcatccgtacggaagaggatgtagagcaggcattgaaagcgggggctgtagctgtcacaacgtctaataccaaattgtggaaaaaatatgaaaactttttgacggaaagtgattgacaccgctttcatgcactgatacaattgcactaggttaatacattgtgatggagaactcggagaccacagcagctctttacggcaaatgtttatgcacccgtaaagcggtttgttgtggtttttttattctcttcttctctatcatgctttttaatcgtgactttaggaggaatgtgctatgacagcattttggggagaagtcatcggtacgatgctgcttatcatttttggtgcaggtgtttgtgcaggtgtcaatttaaagaaatcgctttcattccagtctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatttatctgcattacctcccgcactggaagtcaacggatgatcccgctgccaagctgggtgttttctcaacagggcccagcattccgcatacatttgcaaacgttttaagcgaagtgattgggacatttgtccttgtacttggaatcttggccattggggcaaatcaatttacagaaggacttaatcctttaatcgtcggtttcctcattgtagcaatcggtatttctctgggaggcaccaccggctatgctatcaatcctgcacgtgacttaggtccgcggatagcccacgcttttcttccgattccggggaagggctcatcaaactggaaatacgcatgggttccggtagtcggcccgattttaggcggatcattcggcggcgtattttacaacgctgcatttaaagggcacatcacaagcagcttctggattgtaagcgttatattggttgtggtattgttaggactctatgtttatacgaaatcacattctgctaaaacattatcaaattcaaaatatatttaatcaaaggggagacatcttatggaaacgtacattttatccttagatcaggggacgacaagttcaagagcgattctgtttaataaagaaggcaaaatcgttcactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaactgggcttttaatcgatccatacttctccggcacgaaggtgaagtggattttagacaatgtggaaggcgcaagagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatgaactgctcgacattctaggcgtaccgaaatccatgctccctgaagtgaagccgtcctctcatgtgtatgcggagactgttgattatcacttcttcggaaaaaatatcccgattgctggagcggcaggcgaccagcagtccgcattgttcggccaggcatgctttgaagaaggcatggggaaaaacacttacggcacaggatgtttcatgctgatgaataccggggaaaaagcaattaagtccgaacatgggcttttgacaacaatcgcttggggcattgacggaaaagtgaactatgcgttagaaggaagcatttttgtcgcaggctctgccatccagtggcttagagacggtttgagaatgttccaggattcatcgctaagcgaatcttatgcagaaaaagtggattcaactgacggcgtgtatgttgttccagcatttgtcggactgggaacgccttactgggacagcgatgtgcgcggttcggttttcggcctgacaagagggacaacaaaagagcactttatccgtgcgacactggagtcattggcttatcagaccaaagatgtgcttgacgcaatggaagcagattcaaacatttcattaaagacgcttcgtgtagacggaggagctgtaaaaaacaatttcctaatgcagttccaaggagacctgttgaatgttcctgtggagcgcccggaaattaatgaaacgactgcacttggcgcggcttatttggcaggtatcgctgtgggattctggaaggaccgttctgaaatcgcgaaccagtggaatctggataaacggtttgaacctgaattagaagaagaaaaacgaaatgagctgtataaaggctggcaaaaagccgtaaaagcagctatggctttcaaataaagtaatactatggtataatgattacaagttaataagaacggtcctgagatgaggagagaccacagcaccaaagtgtaagcatgcactttggctgttgtggtctctttttctatttaccgtgacaacaaggaggaaacgtaatgatgaaacatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcgggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacattcggttcatttacaacatctatcgggttaagagtttatgacttccttgcaggtgtgaaaaagtcagaacgaagaagcatgctttcagcaaaagaaacgctgcaaaaagagcctttggtgaaaaaagacggcttaaaaggcggcgggtactatgtggaataccgcactgacgatgcgagactgaccatcgaagtcatgaaggaagcggtgaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacggaaagcatttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaaatcaatcaattacatgttcccggaactgaatattactgcgaatgacatcgaatccagctgggcggggctgcgtccgctgattcatgaagaaggcaaagatccttctgaaatttcacggaaagacgagatttggacatctgactcaggcctgatcaccattgccggcggaaaactgactggatacagaaaaatggcggagcacatcgttgatcttgtccgtgatcgcttaaaagaagagggcgaaaaggattttggaccatgtaaaacgaaaaacatgccaatctctggcgggcacgtcggcggttcgaaaaatcttatgtccttcgttaccgcgaaaacaaaagaaggaattgcagctggtttatcagaaaaagacgcaaaacagcttgcgatcagatacggctctaacgtagatcgcgtctttgaccgggtagaagcgctgaaagatgaggccgcgaaacgcaacattccggttcatattcttgctgaggcagaatacagtatagaagaagagatgactgcaacccctgctgacttctttgtccgcagaacgggacgtttattttttgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataaatcataacgggctgtctgcagcccgttatttctttttacgtgccgaaagggccagatctcaggttatcaagtgacagaggcacccgcttcatataaaataatggcataagctgatacataggaggacgaatatgacttggagaaagagctatgaacgctggaaacagacagaacatttagatccggaattaaaagagcgccttattgaattagagggggatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataaatctccggagttcgcgatggaagcggcaaaaacacttgcgacacaaggcattcaaacatacgtgtttgatgagcttcgcccgacgccagagctgtcattcgctgtcagacagctgaacgcttatgggggaattgtggtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtcgatttctgtacatcctgaattatcggaagaagtagatgtaaaggttgttttcacaccgttgcatggaactgcaaataaaccggtcagacgcggacttgaagcactcggctacaaaaatgtaacggttgtcaaagaacaggaactgccggattcaaacttctccactgttacatcgccgaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgctgctgcttcattaccttctttctgaaaagaaaaaacaaggcatcctgcctgataatggtgttgttctcaaaacgatcgtcacaagcgaaatcggccgtgctgtagcttcttcattcggccttgatacgattgatacgctgacaggctttaagtttatcggtgaaaagattaaggaatacgaggcatcaggccagtataccttccaattcggttatgaagagagctacggttatttaatcggggattttgcccgcgataaggacgccattcaggctgcgcttttggcagttgaagtttgcgcgttctataaaaaactgggaatgtctttgtatgaggcgctcatcaatctctttaacgagtatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaaacaaagaagaagctatcgacttgccaaaatcaaatgtactgaaatacttcctggaagacgggtcttggttctgtcttcgtccttctggaactgagccgaaggtgaaattttatttcgccgtaaaagggtcatctttggaagacagtgaaaagcgacttgccgtcctttctgaagatgtaatgaagacggttgatgaaattgttgagtcgacggcaaaataattcaagtatgagctgggtcattgtaaatgatccagctttttctttttctcatccaaaagtctgaaagaaaatcatcccatcagtgaagtaatgaaatacaaaaaactggtataatcttaaatacaagatcaatgccggagtgagaaacgtgagcaaaacgaggatggaaaaattaaaaacgctgaaaacgattgcggaaaccttaaatcaagggcacgatatcaaagcaacactggatgaggttttaaaagagttgctgagtctgacaaaccttcaatccggatggatttttctgatcgaagaagatgggtcttatacgttagcggccgacgcttatctgcccccggctttaagccgcaaggaaaaagtgctgatgtgcgaaggggagtgttactgcctgacgaaattcaataacggagggcttagaaaggctgcaaatatcatgaactgcaaacgcatcgaatcagcagaaaacctgcattgttttgacacagaagggattacgcatcatgcaactgtgcctttagaagacggggacagaagattcggattgttaaatgtagcggcggccggaaaaaccatgtttgatgaggaagagctgcatttactcgagtctgtcgcctttcagatcggaacggcaatccagcgtatgaggctttctgaatatcaacaaaaaaatgctcttttaatggagcgtaaccgcctcgctcaggagcttcacgattcagtcaatcaaatgctgttttccgtcagtttaactgccaaagctgcgaagacactaacaaaagatgagaatttacagcagatgattgatttcatccaaaacctatcacaggacgcgctcgcagaaatgaaagcgttaatttggcagcttcgccccggaggattggaaaaagggctggctgaagccattaaaagctatggtgcgctcattggattgaagatcatttttacacaaaaaggctgtcctgttctgactgatgagcaggagcatatgctatggcgtgtcgtacaggaagctttaagtaactgcaaaaagcatgccggaacggatacggcgtatgttagtctgactgcttctttgtgccatgcggagctggatatcattgatcatggggcaggatttcgctatgaagcgcatgccgatctgccttcacttggcatcaagggtatgaaagaacgagcggaaaaagccggagctaagttttggattgagtcagcgcttggaacaggaacaaagctatccatcaggcttccgctaacaagccgaaaaggaggggcggtatgaaaattgtcattgctgatgatcatcatgttgtcagaaagggtctgcgttttttctttgccacccaggatgatattgaagttgtcggagaagctgcaactggattagaagctctccgtgtcatcgaagagacaaagccggatcttgtgctaatggatctgtctatgcccgagatggacggcattcaagccattaaaaaagcaatacagcaatttccggatacgaatatcattgtgctgacgagctactctgatcaggagcacgtcatccccgcgcttcaggcgggcgcgaaggcgtatcaattaaaggatacggagcccgaggaattggtgaaaacactaagacaagtgcatgctggcgaatacaagctttctacagctattatgccccatgtgctgacacatatgaaaaatcagcacgacccggaaaaagaaaaatactatcaattaacaagaagggaaaaagacgttctgactgaaatagcgaacgggaaaagcaataaagaaatcgcagcagccttgtttatttcagaaaaaacagtaaaaacccatgtatcgaatcttttagcaaaacttgaagtggccgatcgcacgcaagcagcgcttttcgcagtgaaatataacctgaatggagagatcttaaaatgaacatgttagtcataaatggcacgcctagaaaacatggcagaacaagaattgcagcatcctatattgcagctctgtatcacacggatttgattgatctaagcgagtttgtattgccggtttttaacggtgaagcggatcaatctgaactgttgaaggtacaggagcttaagcaacgcgttacgaaagcggatgcgattgtattattatcgcctgaatatcacagcggcatgagcggcgctttaaaaaatgccttggattttctaagcaacgaacatttcaaatataagcccgttgcattattggcagtagcgggaggcggaaaaggcggcatcaatgcgctgaacaatatgagaactgtgatgcggggtgtctacgccaatgtcatcccaaagcagctggtgcttgatccggtgcatattgatgttgaaaatgctacagtggctgaaaacattaaggaaagcataaaagagcttgtcgaagaactcagcatgttcgcaaaaacaggaaatcccggcgtctaaacgccgggatttgtttatgtgagaagggctatttgatcttcataagtcagctctgtggcatgatcaatataacggagaagggaatacagcatcttttctaaaacggcgtaatcctgttcaaaatgatacgcatgcagaaaatgctcaattcgttttgataacaaatcgtcctctgtacgcaccattaaaattaataaattatcccattgagaacgatgggtgtaataaagcgctttatcgtaatcggcataatccatgaatcgcttctcctttcttgggtgagaagttcatgattagtttatgccgcatcctctgttattgacggggcaaaacttggcgtctgcgtcagtaaaggggtagcaatatgagggagacataaaatcaaaatgcctgaatgaagatatcgcttttggtaaacctatgagggaacatattctgggtacaggagactgaaaaaatgaaatctctgccgtataccattgcgcttcttttttgcggattgattatcgtgtcaatggctgcaaaaggtcattcaacggacacaaacgagtccgttcaaaagtgggaacagcttgcctggagcaaaattcaggatgaatataagggtgcttcattttctgattatgcttatatggggcgtacagaggtgaatgatcagcagacgaaagatgtctttcgggtgacagtcagacaaaaagatgacactttttctgttcgggccgaagtctattttcatccggtgacaaatcatatgatcagcatcaacgtctttaggctctaataaaaaactgtacagccgttaaggccgcacagtttctgtttttagaaatatcgttttgcaccgagatagcgctgtttccagtaagagttattcatattggaaatgacaactccggaatcgttggcatttatgaattccccgttgcctaggtaaattccgacgtgggaagggccggctttatatgttgtaaagaaaacaaaatctccgacagcaggctggctaactgatttcattgtgttccaatatcccgctgccgttaatctagatacggatgtgactttgttcagtacatagtaaatgaatccgctgcagtcaaacccggacggtgtcgtgcctccccagcgatacggaaccccaagctgcgctttagcggccgaaatcattgtgttaatcttcgcactcgttgagctggtggtgtttgaagaaccggatgaagacgatgatgaagcttttccggaaatgaccagcttttggccaacctgcaagacatccgtttttaaattgtttttctcacgaatctgctgagctgttacattaaatttttgagcaatcacccataaggaatcaccgcttttcaccgtgtatgtagtcgtcgtgccggagcttgcatttgacgaagaagacgacgatgatgaagagcctgaagatgctttacctgtcagcttcaatacttgtccaacgtaaagcacatctgatttcagattgttgatatttcggatttgctgtacagtcaggttatagttgtttgcgattttccaaagtgaatcaccgcttttaacggtatatttagttgttgctgaagtttggttcgatttggatgaattgtctttagaagacgtatcagagccgcttgattttgttttcaacacctgattcacgtaaatggtgtctgattttaagttgttcaagaccttcaattcagcgatggacatattgactttgtttgcaattttccaaagtgaatctccaagctgcaccttatatgttcccgtagaagatgaagaacttgaactcttattagaactgctttttgaactggagcttgaactcttattagagttgctttttttactggaactagagcttgaagaaacagtaccggacacctttaatttctgcccagcacgaattaaatcgctgcttagtccgtttaattttttcagttcctgcaccgtcattttaaactcatttgcgatcagccaaagtgaatctccgcttttcactgtgtaaacagaacttccgctcttcttggttgttgagcttgaagtagatgaagaagtgctggatttgctgcctggaatagtaagcgtctggccgatcgacagaacagtagtcgaaagatgattggcggatgtgagggccgccacacttgtgttataggtttgggccagtttccataaagaatctccgcttttgaccttaatcgttgctgcttcagctggtgtcactactaaagttgtgccgacaatcgcagatgctgtcagccctgctgctaatttctttttcatcttagctctcctttttcccccaatgattttgcatttgctgtttcttttttatatcggcacatttgtctcatcgttttgcctttttataaaaatagccaaattatcttaacaataagggggaaaaagggcataaaaaatgaaggaatcttgatctattccttcatttttaaaagcttcatgatatcttctttgtttttgacgaggtcgcgcagtgtgtatttgtctaaaactgcgaggtaggctaaaagcgcttcattcagcacatgttttaagccgcaaaccggggaaataacacagagattcttgttcgcatcaaaacattcaacaatattaaaatcgtcctccgtttttctgacaacctcaccgatgttgatgtcttcaggttccatgcctaatcgtatgccgccgccccgtccgcgtatcgtttctacgtagccgagctggccgagcctgtatatgactttcatgagatgattttttgaaatagaatacgtttcggcaatctgttttatatttgaaagttctccgggacgctctgcagccagaaaaatcaacactcttaatgaataatctgtataattggttaacttcataataagacctcagaataagacattttctatatcttatcataatcgattgaaaaatgaaataaaaggaattaaaaaaacatgcacccagctgggtgcatgttttttgcttacatgtcattcggcggattttggtttttacggtttttttcgatttctgtgttttgcattttgcgttcaaatgtagacagataacgtgatgcaaaatccttaccgccaaggccgaaggataaaccgaaagcgagtgcgaagccgctaagaacgatgataaacgcggaattgacgattgtcgcagcgacaccaagctgatccagggccataaagaaagcaagtgcgataatcgtatatttagcaataggcgctaaagacttgaattcccggccttttatcatgcttgagagcacttttctcaccaattctcctgcgtaaaggccgagtccgagaatgaatactgcgacaaggacattcggcagatacgcgatgatgccagtggcaatttctacgaggaagtgcagccgaacaatttgaagcgcctcagctgtaaagagcagaatgacaatgatttgcgcaatcataccgacaacttgagacaaggacagctttgcaggcgttcgggcttccatgcccattttccctaagacagaatcaaagcctgcgcgatggagcagtccggacaccatggatttcacccattttcctgcccagataccggctaatacaagcacgatggcaatcatgatgttcggaagcatgtttaaaatcgtattcagcatagagacagctggttttgaaatgccggcgacatccagctgatcaagcgctgaaatgaccaccggaatcataatcagcacataagcgattgttccgatgactgctgaaaggcttgtgtcttttaagtaaattgataaacccatacgtgccgcgaatctttccgtgccgatgcttgcaaggaaattcgtaatgatatcacggacaaggcgggcaacaagccagccgattaatacgataagcgccgctgcaaataatttcggcagaaaagcgagcacgctttccatcatatttgtaaaaggacctgaaatgccgctgattttcaaagaagataagacccctggcagaaaaacaagcagcacgagataaaagacaatttgtgaagcggtattgacagcctggtgaatatcttttccttcagacaccaaattccacttgcgcagtttgtcactcgtgttcagcttcatcccgatttttttgacaaggaagctcaaaacagaggctgcagcccatcctaacagcagaatgagtccagctttcagcacgcttgggatcgcggctgcaatcgccgaaagcatactgacaaacggcgatgccactgttgtcaggtgcaaaatgttaaagaataaaataaagacgatgatcagtgcgataaaataaacgaccttgcttatgactttttccgaggaatagcgtgaaggctttttcccagcaaagagcttgtcgtcgatttttgttttgctgagtcctttgtataccgctttttcaataattttagcaatagcccagccgattaataagacgagtaaagcaatgattacgtttggcagcttactgagataagaagaaagcacgtctgctacattcaattggtatcgctcctttttcgtagtatggtgtgtgtttacccacttatccaataagcaaacagatgaatgtgccgggggaattttttcttgcccgagtgagactatcatcttttgtctggcgggctcatacattatagataagtccaagtaggggggattcggttgaacgcggaggagaagaagggattacagcgggcaattgaggaaattaccgaaattgcaaaaggattcggccttgatttctacccgatgagatatgaaatctgcccggctgaaattatttatacatttggcgcgtacgggatgccgacaagattcagccactggagcttcggcaagcagtttcacaagatgaagctgcactatgatctagggttaagtaagatctatgagctggtcattaactcagatccatgctacgcttttttgctggacagcaactcactgatccaaaataaattgattgtcgcacacgttcttgcccattgcgatttcttcaaaaacaactgccgtttccaaaacacgaagcgcgatatggtggaaagcatggcggcaacggctgaacggataaaacactatgaacaggttcacgggattaaagaagtcgaatcttttttagatgcgatcctttcgattcaggagcatatcgatccgtcgttggtccgaccaaagctccaatggagtgtggatgatgaggaagaggagattgaagaggcagccacgccttacgatgatctatggtctttggatgaaaagaaaccgaaaaaacaagtgaaaaaatcgaaaaaaccgttcccgccgcggcctgaaaaagatatcctgctttttatcgaggagcattcccgggagctggagccatggcagcgtgatatattaacgatgatgagagaggaaatgctttatttctggcctcagctggaaaccaagattatgaatgagggctgggcttcctattggcaccagcgaattatacgtgagcttgatttgacctctgatgaagcgatcgagttcgccaagctgaatgcaggtgtcgttcagccgtctaaaacaggcattaatccttattatttagggctgaaaatatttgaagacattgaaaagaggtacaacaacccgacggaggaaatgaagaaaatgggcgtgcagcctgactccggccgggagaaaatgtttgaggtcagggagattgaatccgatatctctttcatccgcaattatttaaccaaagaattagtcatgcgcgaggatctttatttgtttcaaaaacagggccgagattataaaatcatcgataaacagtggaagtcggtgcgcgaccagctcgtaagcatgcgggtaaatggcggatttccatatttgacagtaaacgacggcgattatatgaaaaataacgaactctatattaagcattggtatgagggaatagagttagatttgaaatatttggagaaagtgctcccttatttattccagctttggggaagaagcgtgcacattgagtcagtgcttgaggataaggaagtcatgttttcgtacgacggaaaaggtgttcaccgcagatatttataaaaaagaggatgcagcgttctgcatcctttttattttccagtttttaaaatcttaaatatgatgtttgcctggtccgtattgttaatcaatccgcggaatttttcttttccggggccgtacgcgtataccggtacttcttcgccggtatgatcggtactcgtccatccgctgttggagcgggtattaaaaatcttgatgatggctttgtaggcccctttgcttttgtcagcctgtgcagctgcttcaacgcttttgatctcttcaggtgtgactttcagattggcatagcgggcgagcacatctttaaccggcttgccttcactgatttttttggccatgaattcaggtgttttcttagcggagagaatcggttctgcgtgccaattcttttccccgtttgcgccaatggtaaagccgccggttgtatggtcagcagttgcaatcacaagtgtatgtttgtcttttttcgcaaattcaatcgcggctttataggcctgttcaaaatctttaacctcgctcatagctcctactgtatcattgtcatgggccgcccagtcaatctggctcccttcgaccatcaagaaaaatccttttttattttggttcaggcgatcaattgctgaaaccgtcatttctttgagagacggtgttttgctgtcacggtcgagcgctttagcaagccctctatctgcaaaaagcccgagcacctgctgatctttatttttcttcaatgcttgtttagttgtcacatagctgtagccggcttgtttgaattcctttgtcaagtttctgtccttgcggttaaaataagattttccgccgccgagcagcacgtctattttatgtttgccttttattttgtcatccatatagctgttggcgatttgatccatgtttttccgcgattcattgtgggcgccatatgcggctggagtggcgtggttaatttcagacgtggcgacaagccctgttgacttgccttgctgtttggcctcttcaagtactgatttcacttttttcccgtttttatcgacaccaattgcattgttatatgtcttaacgcctgtcgctaatgctgttccggctgctgctgaatctgtaatattatagtcagggtcatccggatgcgtcatcatcatgcctgtcaggttccggtcaaattctgttaacttcgggttattcggtgtgtcaccgttatttttcatggaacggtaggctcttatgtaaggcgtccccatgccgtcgcctatcatcacaatgacatttctgatctcagctttgtcttgttttttggcgctggccttttctgtttgctccagctcagctccggcaaagattccagctgtaaggacagaaacagcggcgattggcagaaaatttgatttcatattttgaaacaaattcattttctcatgcctcctttaatgtattccgtttatcatgttagggaaattttgttaaatgcggctgctgatcatgtaaacaataagtaaagccttgtaaggaaatgaaaaaacgcttttcgttatcttgccttatttgatgtaaagcattcatttttcagaaaaatctttacctctctgtctttgcatgatatgtttgtttaaataaaaaaactgcggataaccacagctctcctcgaatattctttatcactcatttttccgatatgtgagccgaccccgaaagtttttcatttatttcctttatgttgaaaaacatcccataaaacatgacaaaagcactcgttttttgtcacctttgcaacgaaaatgaaatatttaatacccttaaaaacttttttttagaacgaataattaagaaatttgtcacatgaagtcaagactatttctgatgggaatctatccttataatagaaatcaataagattaattaaaaaaaagagatacatatatatagagttaacatttggggaggaaaatatgaaaaagcaaatcattacagctacgacagcagttgttttaggatcgacgttatttgcaggagcggcatctgcacaaagcattaaggtgaaaaaaggcgacacgttatgggatctttcaagaaaatacgacacaacgatcagtaaaattaaatcagagaaccaccttcgttcagacattatttatgtgggacaaactttatcgattaacggcaaatctacaagttcaaaaagcagcagttcttctacctcttcttctacatacaaagtaaagagcggggacagcctttggaaaatttcaaaaaaatacggcatgacaatcaatgaactgaagaagctgaatggcttaaaatcagatttgcttcgtgttggacaagtcctgaaactgaaaggttcaactagttcaagcagctccagctcatcaaaagtgtcatcgtcttccacttctacttataaagtgaagagcggagacagcctttctaaaattgcgagcaaatacggcactacggttagcaaattaaaaagcttaaacggcttaaaatcagatgtaatctatgtcaaccaagtattgaaggtgaaaggaacaagcacaagcagctcaaaacctgctttatcttcatcatcttcaagcagcaaaacgtcatctacatcacttaatgtgagcaagctggtttctgatgcaaaagcgttagtcggaacgccatataaatggggcggaacgacaacttcaggctttgactgcagcggcttcatttggtacgtactgaataaacaaacaagtgtgggcagaacaagcactgcaggatactggagttctatgaagagcattgccagcccgtctgttggtgatttcgtcttcttcacaacatataaatccggcccttctcacatggggatttacattggaaacaacagtttcattcatgcaggatctgacggcgtacaaatcagcagcctgaacaacagctactggaagcctcgttacctcggtgcgaaaagattctaatttttagagaaaacccgttcattggaacgggttttttttattagacggagcataggcgttttggttgcttctaaaaatgaaaatgtgataaaaaatccaagaattttttttctttcttattttcataaagcgcaatcgcgtaagcgccggcatagggcagctgtacagactgataaggaattctgatcatctgtttctctgctaactcacgctttactgtagataaaggcagaaatgaaactccgagtccttccttgataaaccgtttcgttatatgtgtttgagtgaccttcattgttctcacaaatggaaatgtcattctgacttgacggagcaagtcgtcccagtaatcaggatgattatgggtcaaaagcaggtattgttcgagcacctctttggcatcaatttcgttgtcttctatgaaacgcttatcgggcggggcaacaaggacgacagggtctttgtataagcagtggcagcttaaagaagaagactgtacctttaaacagcttagtccgatatctgcttccccggctttaatcagtgacgcgatttccgctgattcgaaaatcgtaaccgccatttctgtttccgtattcattgctgtgtaccgtttcatgacagaaggaagcacagtatctgcaataagcggagaaaccgcgagctgtaaggtttgagagtagccttgtctcactctgtgaagctctgccatgctgttttcataatcatcaagaagcctgagcgcatacggcaaatacgccctgccttcatcagtcagctggatttgcctgcctttacgctcgaacagcttgcagctgatttctttttctaattgcttgatatgtacggtcacagtgggctgagataagaaaagcgtttccgctgtttttcggaagttctcatattttgcagcggtcacaaaggtgtgaagccatttgaaatccatttctattctcctctgattaatatttttaattaattccctttaaaatattcattattttttaaatattatatttactataataacagaaaaggatagggggaatacaaatggtacattacggattaaagggaattacatgtgtggaaacatccatcagccatattgatggtgaaaaagggcgtctgatttacagaggacatcatgcaaaagacatcgcactgaatcacagctttgaagaagcagcttatttgattttatttgggaaactgccttcaactgaagaattgcaggtatttaaaggtaagctggctgcggaacggaatcttccggaacatattgagcgcttgattcaatcactgccaaacaacatggacgatatgtcggtgctgagaacggttgtttcagcattgggggtaaatacgtacatattccatccgaaaacagaggaagcaatccggctgattgcaatcacgccttccatcattgcatacagaaaaagatggacgcgcggtgaacaagcaattgcaccttcttcccagtacggacatgtcgaaaactactattatatgctcacaggcgaacagccttcagaggcaaaaaagaaagcgcttgaaacctatatgattctggccatggagcacggcatgaacgcatccactttttcggcacgagtcacgttatcaacagagagtgatttagtgtcagccgtcacgtctgctctcggcacgatgaaaggtccgctgcacggaggcgctccttctgcggtgacaaaaatgcttgaagacattggagaaaaagaacatgctgaagcatatctgaaagaaaaactcgaaaaaggagagcgcttgatgggattcggccacagggtgtacaaaacaaaagacccgcgggcagaagctttgagacagaaagcagaacaggtggccggcaatgaccgtgatcttgatcttgcgctgcatgtagaagcagaagcgattcgtttgctagaaatctacaaaccgggacgaaagctatacacaaatgttgaattttacgcggctgcagtgatgaaggccatcgattttgacgatgaattgtttactccgaccttttcagcaagccgaatggtagggtggtgcgcccatgtgctggaacaggcagaaaacaacatgattttccgcccgtcagcgaaatataccggtgccattcccgaggaagttctttcataacatattttggcgtttattcatttctttcatgtggtaacgttcagtatcaaccacatgtctaggagtgatgaatgtgaacccaatggacagacaaacagaaggacaagaaccgcagcatcaggacagacagccgggtattgagtcaaaaatgaatccgctgccgctgtcagaggacgaggattatcgaggaagcggaaaactgaaaggaaaagtcgcgatcattactggaggcgacagcggaataggtagagcagcagctattgcctttgctaaagagggggctgatatctccattctatacttagacgagcattcggacgcagaggaaacacgcaaacggatcgaaaaggagaatgtccgctgcctgcttatcccgggagatgtcggggacgagaaccattgtgaacaagctgtgcagcaaacagtggaccattttggtaaacttgatatcttagtgaataacgccgctgaacagcatccgcaggacagcattctcaaaatttcaacagaacagctggaaaaaacctttcgcacaaatattttttccatgtttcatataacgaagaaagctttgcctcacctggaagaggggagtgccattattaatacgacatcgattaccgcttatgaaggggatacggcgttaattgattattccagcacaaagggtgcgattgtctcctttacgcgttccatggcgaagtcgcttgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggcggccgttttatttcaacgtaatcaacgaaaaaccagctccagagctggtttttttgtatggtaaaaaatttcaaaataaaaaatttgtcgatttttctaacaattttgttttcatttttgcaattttatatataatattgagtaggagaaaggaatgattcgcgaccagtacaaatatagtagaaaaaaagaaaaatgaccattgttgctcatgaattcagaaaattcaaataaaatatataaaaatagatgatcgggagttgaaggggaatgaaagggagcgtttttaggaagaagagcattcaggatttaatcgctgcgacgagcggggaaaaatctttaaaaagagaattaggggcatttgatttaacattgcttggaatcggcgccattattggcacagggatttttgttctgacgggaacaggtgcagtcacggccggtcccgggctgacgatttcatttgttgtggcggcgctggcttgtttattcgccgccctgtcttacgcggaatttgcgtcaagtgtgcctgtttcaggttcggtgtatacattcacttatgcgacattgggagagcttatggcctttattatcgggtgggatttaattttagaatatatgctggcggtaagtgcagtgtcggttggctggtctggttatttccaatcgtttttatcagggctcggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccgatgggctttggcggcgtgttcagtgcagcggcgctcgtattctttgcttttatcggatttgacgctgtatcctctgctgcggaagaaacgaaaaatcccgcgaaggatctgcctaaaggcattattttctctttattggtttgcacgattttatatgtcaccgtatcagcgatcatgactggggttatcccgtttgctcaatttgcgggtgtggatcatccggtttctctagttcttcaaagcgcaggacaaaattgggtggcaggcatcattgatattggcgccgtgctgggaatgacaacagttatgctcgtcatgctttacgggcagacacgcgtcatgtttgccatgtcgcgtgacgggcttgtgccgggctcactttctaaagtgcatccaaagcacaaaacaccttatgtagccacttggtttttcggaacgatgtcggcgcttctcggctcacttgttccgctggatgaacttgcaaagctggtgaacatcgggacgctgtcggcatttgtactgatttctgtggcagttatcgttttgagaaagaagcaaccggatcttccgagagcctttaaatgcccgggagttccgtttatcccaggcctggcaattctgttctgcctgttcttgattttaaatctgggatgggtgacgattgtccgcttcctagtgtggctgttaatcggcttggtaatttatttcctgtattcaagaaagcattcaaaattaaatcaataaataaccttttgataaagagagcggtcatacaggccgctctcttttctgttcctggcaaatgaatctatagaaatgaagacaaaaataagagataatataggctggaaaggaagtgacgtttattgtctgagcaaaaaccagtccaatgggcttcgaaaattggtttcgtcatggcagcggccggctcggctatcggcttgggcgcgatttggaaattcccttacgtagcggggaccaatgggggaggagccttttttcttatcttcgtgttatttaccatcctcttaggctatccgcttttggtgggggaatttatttttggaagacggaaccagacgaatgccattgatgcatataaaaaagaagcgccgcgatcagcttggtttcttacggggtggatcggcgtagccgcgtgtttcttagtgctgtcgttttacagtgtaattgggggatggattttgctgtatatcgtaaaaacggcgtcaggctcactgtccgggctttctcaagcacagtatggcgctctttttgcttctattatccaaaatccggtgcagacgctcgcggctcagcttgtctttatggtacttactgtcattgttgtcgcaagaggggttcaaaaagggattgaacgggtaagcgcggtgatgatgccgattttgtttttattgtttattctgctcgttcttcggtctcttacgcttaatggtgcaatggaaggcgtaaagtttctgcttgtgcctcatttcggcgatctgactccggaatccatattattcgcgctgggacaggccttctttacgttaacactgggggtttcggtgatggtgacctacagctcctatttgtcgaaaacacaaaatatccctcgttcggcagcctccattgtcttgatgaatatcattgtgacactcttggcaggtttggctatttttccggcggttttctcattcggttttcagccaaatgaaggaccgacattgctgtttacagtgcttccggccgtttttgaacagcttccgttcggcacgttgttttttatcggttttctcgttgcatttttatttgcagccttaacctcagcattttctatggttgaaattatcgttgccacaatcggaaaaggggacgaaaagaagagaaaaaaactgtcatggacgagcgggcttttgatctttttggtcggaatcccatgctgcttgtcttatggcgttttgagtgatgtgcacctatttggcaaaacgttttttgatattgccgattttaccgtcagcaatgttttgatgccttcaggcgctctgttaatttctctatttatcccgctgaaaatttcgaaaagcgaactcttggctgaaatgcgaaatggatcaaatgcaggtaaagcattcttttacacatggttttatttgcttcgttttatcgtgccgcttgccattattatcgtgttcttaaatttaatcggaattttatcattttaaaaaacaggctccgtttcaggggcctgttttttatttaataagatgatatcaacggtgcccatgccgttttcagtttttggatgccgagcctgatgtcctcttctgacaaaccgccataaccgattaagacagaagcaaaaggcgtctgttctttatatgagggagacacgggatagatggttacaccgtggtctgcggctgcttgtattgcttcttcctcacttgctggaaacaaaaggcgcagcagaatgtgaagccccgagttcttaccgagaatctcaacggtgtttcccagttcagagcgaatggcttctaacaggatagcgtgtttttttcggtataagcttctcattctatttatgtgtttttgccactctccggtttcgatgaagtctgccagtgccaattgcgagtgggcagaaacggtctgcttcattaactgagcattgttttggatcggttccatgagttcagggggcacaatcatgaagctgagccgcaaggaaggcagaagtgactttgaaaaagtgcccagatatatgactctgccattcggatcaagaccctgtaaagacggaatgggatggccgctgtagcgaaattctccatcgtaatcatcttctataatgaatgaatttgtttctgccgcccatgccagcagctcctgtctgcgggtaatcgtcataatggtcccaatcggaaactgatgcgaaggagtcgtatacatgagataaggattctgacggtagagctcatccggcaggacgccttctgcatcagaacaaatcggagtgacatccatgtgatttgcttcaaacatccttcttgaacggtgaaagcctggttcttcaaaaccgatttttgtacctggctttagcgaaaggcaaagaatttgcagaagcacggtggttcctgcgccgatgataatctggccgggctcgcaatttactccccgagacagcctgacgaatcgggcaatcatgtgtctgagttcgtattctccttgagggtcgccagaggtgtgaaacaatccggaatagcgctcaagactttttactatgctttttctccatgcgttaaagggaaagagggtcggatcaacgctgccctgatggaagtcaatagcaggtgcgttcttttcatgtaatcccggctgtacagactgctgaaaatggtcaggagctgtcgggaatcctggttctacttccgccgcgaaccagccgattttcggcttgcttttgacatagccctcagcagttaattgctcataagctcgttctatagttgccgtgctgacatcgagcaagctggagagcctgcgttttgacggaagtcttgttccctttgtgattcgcgcatgtgaaatttcttgtttaaaaaaggtataaagctgttcatacagcggtgttttgctctttttatcaagaaacggcgtaatatccatctcatgtctcctttgtagctggcatggtcattttttctgatattggctatttggcaaatgccatttattagctatgatcattgtaacgaaaggaaaggggattgagaagatgatccatatgaaacaattaacctcgaaagaagaatgggctgagtcgtatccgattatgagtgaattgagaacagaactggatatagagacgtatttacaaaggcttgaagcctgtgtgcagaaagaatcgtatatgctgtttgccttatatgaaaatacagcaatcagagcgctgtgcggggctctgccgagagtttccattcataaaggagagcacttgtggattgcggatcttgttacaacggcaccttgccgatcaaagggatacggcaaaatgcttttggattatgcctcagactgggcgagaaaagccggactcggttttgtcagtctttcatctggcctgcagcgtaaagacgcacatcgattttatacagataaaatgggttttactatagaaagttatttgttccgaaaaccggtataacgaaaaaagacgcctgaaaaggcgtcttttttaaaagccaaactgtaaattcgtatctacagatacaatggtatacacacaaataatcacaaagagattaaggatgacgccgagcaggcctggacctgtgcgccctctcttgatgaagagttcaacaacgccgaacggaacggcagccatggcgaacggaagcatttgataggaataaaacgtgacgttgctgataatggccaaattcagcaacagcagggacagaaccgctgtcccgacagagatccagccgaatacattgtgttctttaaaaattcttaccagttccataattccacctcgccgacattcgctgattttacagatttatttttcagcatgcgctggatttccttggttggccctgtaacgaccgaaccgtatacattgacaccgtttttctctacataatctaatcggttatctacattcaggtctttccgttttgaaatgacctgagcccatttttcgtgtttggacatgaatttcagggcgttgataaactgatcgccattcgacttgccttttgtattaagggcggccaagaactttgaatcctttccaggatagccaagaggttctgtggaagctgtcttatttgtgtttttctctgtttcgattgcgttccacaaaaagctcacatcatagcctttgaatttgttatacacgtcttttgtcggatatgcacggtcatatgaaaggtagacctctgataccgttccttcaggcaatgtgcttaacgttttttctgcttttgcggtcgtttgttcagacttgtttgaaggatgtgtaaagtaatggccggttttattcacttctaagtcatagtagtttactgccggcgcttttactttgttataaaacatttcaacccgttcattccctacggcagccgtcttcgtgccaatctgcttttgcagcgggaattccgtattcattccaaatagcttcacttggcttttcagtccggaagtatcaacaagaacattcggcatggtcagggctacagtgactgcggcagtttccataaactcattgccggtgctgtgtttcccacccattccgtaatagaggtagcttcccagcgtacaaagcggcaaaatcatcaatgtcgaaatgacggcaagcacagaaattcgcaaataagacttgcgtttgccgtaggctaaaatcgctttttgtttttcaggactgatgctgagatcccaatcgttatcgtcctctagttcgctgtcaatcagttcctgatatacttcgagcttctcaagttcttcctcaaatgcagtcatttcctggtcgctcatttccccatttttatattgatcaaaacgctttttaaattcttcattcatcattaacacctctattataaagtgctttcagccgctgtctggcacgaaataaaacacttttaaaattcgcctctgaaatattcataatatgggatgcttctttgtagtttaactcttttaaataatatagcgttaaggcctcccgataattatcggggagctcggacatataaccagtcagcacttcctttatctctacctgatgggcaggactttgaacagcattttgaaagaggcttccgattaagtcatcagaaatggttacttctttcttatgctttctgacgtaatcaatgaaggcgtttcgcgccacttgaaaaagccagggctttactttgctgtgatcataggagtgaatgtgtatgtatgcccgcataaaggtttcctgcagcaagtcttcagcaagatgcttgtcttttgtcatggagagcaggaacctgtaaacatcattcatgtacatttggtaaatttcatcgatcgtcactgccttttctcccctctatgttatacacgcataagaaaggtttaaagttgcacattacatgcaaacggcttttttatacctaatcaaacaccattactatatagtacccaaaaatggccgcaaaagatagtgcggagaaatgtttaacattttttccagaggggaaaagatagtgaaaaagtgaaggagtggcacaatggaatataccagtatagcagatacaggaatagaagcctccagaatcggcctcggcacatgggccattggcggaacgatgtggggaggcactgacgaaaaaacatcgattgaaacaatccgcgccgctcttgatcaggggattacactgattgacaccgcgccggcttacggcttcgggcagtccgaggaaatcgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaagcggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgtccttccttatgcgaaagataacaagataacaacattattatacggcagtttatgcagagggctgttaacaggcaaaatgactgaagaatatacatttgagggcgatgatctgcgtaatcacgatccaaaattccagaagccccgctttaaagagtatctttctgctgtgaatcaattggataagctggcgaagacacgttatggaaaatcagtgattcacttggctgtcagatggatcttagatcagccgggagcggatatcgctctttggggagcaagaaagcctgggcagcttgaggccctatctgagattacaggctggacgctgaacagtgaagatcagaaagatatcaatactatattggaaaatacgatatcagaccctgtcggaccggagtttatggccccgccgaccagagaggaaatataacaaaagctgagggcgaatcctcagctttttggcgttttaacgggagaaatcttaaaaattagtaccaggtaataaaaaatgttgttataatagatgacagaaagaatcattgattacgacaaaggaagtgcgatatgtataagttttgtgcaaatgctttaaaagttattctttctcttcgcggaggagtgaaggtgtataacaaagaaaaccttccggccgattcaggttttgtcatcgcgtgtacacattccggctgggttgatgtgattacactcggagtcgggattcttccttatcaaatacactacatggcgaaaaaagagctttttcaaaataaatggatcggttcgtttctgaagaaaattcatgcctttccggtagatcgggaaaatcccgggccaagcagtattaaaacgccgattaagctgctgaaagaaggagagatcgtcggtatcttcccaagcggaacaagaacctctgaggatgtgcctttgaaaagaggtgcggtgacgattgcgcaaatggggaaagcgccgcttgtccccgctgcatatcagggcccttcaagcggaaaagaattattcaaaaaaggaaaaatgaagctgattatcggtgagcctcttcaccaggctgattttgcccacctgccttcaaaggaaagacttgcagcaatgacagaggctttgaatcagcggattaaagaactagagaataaacttgatcagctataaggcgttctgagagattaccctgaactgtaaaaataagaaaagcaccttatacaaggtgcttttcttattatgcttcctgctggttagctgtctccagaagttcttcttcttgaagctttttcacttcaatatatgcgacgtggtggccgtcaatttcattaataatgaattcgcagccctcttcgatgatggaatcatctttttcaacatcgtatttttgagtaaggaaccagccgccgattgtatcgacttcttcgttctctaaatgaatgcctagcaggtcgtttacttggtcaattaacacttttccgtcaagaatataatggccttcgccgattttgcggatttcgctaatttcatcaatatcaaattcgtcgcggatttcaccgacaatttcctcaatgatgtcctcaaccgtcacaagcccggcagtaccgccgtattcatcagacaaaatggccatgtggaccctctctttttgcattttgacaagcaggtcttggatcggcgcagattcaatgacatgaatgatagggttgacgaattgagaaatggtggaatcaacagatacctcaccgctgatgcaggcggtcagcacttctttaatgttaataaccccgataatgttatctttatcgccctcttccacagggtagcgggtatatttttcaatctgaatgatgtccatcatttcagaaatcttgatatcatgcggaaggctgacaatttcggtccgcggaatcataatttctttcgcgagcctgtcgtcaaattcaaagattttattcacatatttaaactctgattggttgatttcaccgcttttatagctttcagacaaaatgattcgcagctcttcttctgagtgagccagttcgttttctgaaacggtctccaggccaaatgctttggtcaataaccgtgcggaattgttcaaaagccaaatgaatgggaacgcgatgcggtaaaaccaaatcagcggtttcgcaaacagcatagacactgcttccgccttttggatagcgactgtcttaggtgcaagttctccgacaacaacgtgtaagaacgtgataatggcatacgcaaaaataaacgatatgacatgtgaaagggaacctggaacgttcatttggacgaaaagcgggtgaagcagcctttcgatcgttgattcacctaaaacccctaatccgatggaagtcaatgtaattccgagctgacacgcagataaatattcatcaagatgcgtggtcactttttttacggctattgctgctttatttccttccgcgatcagctgatcgatccgtgagcctctgattctgataatggcaaactcagatgccacgaaaaatgccgtcagggcgattaaaacagcaactaaaatcaaattcactatgtccaattagaaccttcactctagcaatgagaatgaaggtaacacctcctgttagataaaatggttttaacttaacagcagcataaatgattggaacacggcgagcttttcaggcgggagtttgcttttcagcttgtcacgatcctcgggcttcagccgttcaaaccgatgcaagattccggagatgttttgattcatatgatcaatttctaatgccagatttccaatttcatcatcaagtttagctgaagagggaaactggttctccagtcgatctttaatatcggacagggccaatcgctgcttcttgcaatctacaataaatataagtcgtttgagtgcattttcgtcgtagtaacggtaatttgaacaggatctggccggcgtaagcagaccgagattcgtataataatcaactgtccgtttcgttactccggcgagtgccgctagttcactgatgcgataagtctcagccccatctatatccctcccaaccatcacgttatagttatgagaatagtttaatatatgaacggtgtcttgcacaagtttattgtttttttcagaccggaattggaagttgtggaattcatcatctgattgaagtaacataggaagatagaattttcaaatttttatatgcggaagggacagatgaaattggctgggttatcccgggaagttgaagaaaatttaaataaaggatcatggattcgcaagctgtttgatgaaggtgcaaggctgaagaaggagttcggggaagaccaggtatttgatttttcactcggcaacccgattgttgaaccgcctgaagcttttaagagagcgttaatagaggaagctgaaaaaggcagccacggatacatacaaaatcaagggcttcctgcagcgagagaaaaagtcgcgcaatttctggggtcacgttttgaagctgatttctcagcggagcgtatcgtcatgacggtgggtgcgggaggcgctttgaatgttgcgttaaaaagcatcgtaaaccctggggaagaggtcattattctcgcaccttattttgccgaatataagttgtatattgagaactacgggggaaaggccgtcagctgcccgttgacaagccggtttgagatcgacattgaagcggtaaggcaatcgatcactccacagacgaaagggctgattctcaatacaccgcataaccccacaggcactgttctcagccagaaaaatatagacgatttaggcgctttattaaaagaaatagaagagaagagcggccagacgatttatgtgctgtttgatgaaccgtacagtcaattaatctatgatgaagagctggcaaatccgtttcgatcgtaccatcgtgtgatattggccagctcattcagtaaagatctcggcatagccggagagcggctcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagcgcttataaagagcgccgggatttaatggtagacattttaaaagaagccggttttgaatttgaaatgccaaagggaggtttctttgtttttccgaaatcgccgattgaagatgaagttgcattttgcgtgcatgccgcccaaaaatacaaattattaattgtgccgagcagcggttttggaatgagcgggcatttccgattatccttcagtgtgccgatcgagcagattaaaaactcacgggacattttcatttctttatataaagattttgcttaagaaggcaaagaaaagaaaacagttttcaaggctgttttctttttatatccgcaaaatccttcctcttccaatccagacaggcggagaattgacaagcaggcatgcagttaaggctttcttcatgataaaagtctaaaaattaaaaatcatttttggaatgagttgtgttacaataaaatatacaatttataatcaaactttgacttttggaggtggtatgatggggccctctgcttaggcaacaatacaccgcgtacctcaatgttaaggaaaaatgattatatcaggaggtgactccttatcctttgttgagaggatagggttaaatggacgatattgacagtctgattttaattggcgtgctcattgctttaaccgcgtttttcgttgcaagcgagtttgcgattgttagagtaaggagatccagaatagatcagcttatcacagaaggaaacaaacgggcgatactcgcaaggcgtgtcattacagatttggatgaatatttatccgcatcccagctgggcattacattgacatcaattggacttggcgtactgggtgaaccggcctttgaacggctgctgcatccactgtttgaaccgctcggcttgccagactcggtttcacatgcagcctcttttgcagtcgcgtacggcttgatcacgttcctgcacgttgttgtaggtgaactggccccgaaaacggtcgcgattcaaaaggcagaacagctgactttactgatagcgggccctttgcgtttattctatttgctactgtttccatttatttggatcctcaatggatcggcgcggcttttatgcgggatgttcggtttgaagcctgcgtcagaacatgatggttcccattctgaggaagaactcaggatgctgttatctgagagtttaaaaaacggagagattaatccgtctgaatataaatatgtgaataagatttttgaatttgataatcggatcgccaaagagattatgataccgcggaaggaaatggctgctgtgtcaactgagatgacaatggccgagatgctcgaagtcatgctgaaggaaaaatacacgcgctggccagtcacagatggagacaaagacagtgtgatcggtttggtcaatacgaagcatttgttttctgatttgctgtttatgacagaagaagaacgaatgaagatgacgatccatccgtatgtgaggccggtcatcgaagtgattgaaacgatcccggttcatgacttgctgattaaaatgcagcgcgagcgcattcatatggctatattgtcggatgaatacggaggaacctcgggacttgtgacgacagaggatattcttgaggaaattgtcggagagatcagagatgaatttgatgaagatgaacagccgctgatccaaaagcttggcgacggccattatgtgatggatggaaaggttcggatcgatcaggtgaacagccttcttggcgcatcgattcaagaagacgtcgatacgatcggcgggctgatattaaaagaaaacatcgatattgaggctggtgaatccattcgcatcggttcatatacgataaaggtgctgaagatggacggccgattaatcaagcaaatcgatataaaagaagaagccggcaacacaaccgggattacggcgcaccacaagctgccgctgcctgagcctgtgatgctgaacagtgcaaccttgagcgagaaataagctcaaggtttttttacattgtgattgtccagccgcaccaaaatgtcaaaagcgatccgcaaagtgtcagggcgatgtacaagatgctttctattacacgtttggccataaggagttgaatactttcaacgctgaaggtggaaaaggtcgtaaaggcgccaaaaaaccccgtgccgatgataagcgagaccgaagcatttgcaacgtgaagtcctgtaaatattccgagcccgagagctccgagaatattgactgtcagtatgccaatgggcaggctcagacctttggttttggcggttatgacattgccaagccagaagcgaagcattgcgccaagtccgccccctatgaaaatacccgctagtgtcatctttcctgcagcccctttctttgctgaatgcctgctatgcgccgtcccgcaaaaacaccaatcagtgcaaatatgatccctgatatcaatgaggctgccatatataaaagagccaatgagggttgtccttgcaaaagcatcactgtttccttagaaaacgtggacattgttgtgaagcctccgcaaaagccggtgcctaaaaaagccgacagcagaggccgttttgccccgatcataaaaaatccggtcaaaatgcctaatagaaggctgcctgccgcattttccagccaggttgccgccgggaactgaccggtgtgtatccataagtttaatccgtatcggaggcaggcgccaagcgcgcctccgataaaaaccgcgctatatattttcatgtttgccatcctttatgatgaaatccgggtaatctgtaacgatgccgtccacgcccatggcttgtaattttgccgctgtcttttgattgttgacagtccatgcaaatatgtttaagccatttttatggacggagccgattatcagacggttgagccgtgtgtattttatattgacatagtttgcaaaagagcggaaggccttcatctgatttctggacagcatgccaaagttgggccttgtaatgaccgctgtcggaatcgaaggataaagctcgcggaacctttggacggagcggaactgaaaggattgaacaatattattgatagaaaaagaaaattgccctaatagctgtcccacctcttcttcaattccgacttgagacggatggccttttagttcaattaaaaggccgatttttttgtggtagcgcttgagcaccgcttccagggtcggaatacgctctccttgaaaagcgggaccgtaccagcttcctgcatcgagtttttgcaattcctccaaggtaaaatccttaacaaagcccgatccgtttgttgttcggtcaaccctgtcatcgtgtatcacaacaatctgcctgtcttttgtaagctggacatccagttcgatcatatctgcattcattttcaccgcaaggtcaaatgcggcaatcgtattttccggagcgtagccggatgctccgcgatgggcaatgatgtacaagctaagtcagctcctcgtatgggcatttctgttattgtatcaaatccatatatgcaccgcgatacaaactggtgaattttttctgccatatcggaatggtccgggctgaggaatgcgtataactaaaaaaagacactcagcgtatcagaacacatttcgtcagaaaattaggtctttcgacatgttcacaacaaaatatgatcctttataatagcaaaaaaggaggcgagatcatgggaaaagggagaatcagagtggaggaaagaattaaagccgaaacggatgctgaaatgcaaaaagcaactctccttgatcagacacaaacgaaaaaaggtaagtgactgtccctattgaatctggctgatagatgaattgagaaatgaccccggcgtttcgccggggttttgtgctgcaaaagacatttaaatgaacatctttacgaatattttagtataataaacaattgattgggatagaggggagacagtcatgccggattatctgcagcagtattttacgcttgatatcatcattcaaatcggcatcagcttggcgattttgctggtgtttcttatacttagaaaattattcacaagatatttctttaacctgctttttaatttgacaaaccggccgaaaacagaaatttttaaacaggtggttctggcgtttgataaaccggccagatggttttttgttgcccttgggctgtttttagcgatccggtattcaccgtttttagatgagcaaatgccggtcatcagcaaaatataccgctcactgattgtggcgctcttgtgctggggtctttgtaatttgaccgcaacatcgtcgtttatcttccataaggtgaatcagcgctttgagcttgacatggatgacattctggccccgtttttatccaaattgctccgttttgtgatcattgcgctcagtgtcagtgtgatcgctcaggaattcaattatgatgtcaacggatttgtagcgggcctaggtcttggcgggctggcttttgcgcttgccgcgaaggataccatcagcaacttcttcggcggtattattattattactgaaaagccgtttacaattggtgactgggtggagacgtcgacagtaacaggatcagtcgaggatattacctttaggagcacgagattcagaacagcacagggggcgcttgtaacggtgccgaactctacgctgtcgatggaagcgatcacgaactggacaagaatgaccaaacgccagattacgttttccatccatgtgtcctacgctacgccgattgagaatcttgaacgctccattcattctctcagaacaatgctcttagagcatgagggcgttgataatgaaacaatcatggtcaacttcgatacgtttgccgacagctactacaatttattttttaacttctatacaaaaacgacagtttgggctgaaaaccttaatattagagaggatatcaactataaaattattgagattttaggtgcagaaggtgtccagtttgcatatcccggccaaatggttgttgtcaagcaaaagcacgaaagcgacccattccaggtgaatctaaataaagaggaaaaggaacgggcttaaaagagagacttcgtctgacagaggcggagtctttttcatggtaaaataagagaaaaaggcggtgttgagttggaagcattcaaaagtattctacatgaagcacagcgaattgttgtgctgaccggagcgggaatgagcacagaatcagggattcccgactttcgttcagcagggggcatttggacggaagatgcctcaagaatggaagcgatgagccttgattattttttaagtcatccgcgtctgttttggcccaaattcaaagaattgttccagatgaaaatgagcggcagctttgaaccgaatgaaggacacttgcttttagctgagctggagaagcaagggaagcaggtcgatattttcacgcaaaacattgacggtcttcataaaaaagcggggagcaggcatgtatacgaactgcatggttctatccagacagcagcttgtccggcatgcggcgcccgatatgatcttccccatttgctggagcgggaggtgccggagtgcacggcggccggaaacaatggggacatttgcggaacggtattaaaaaccgatgttgttctctttggcgacgccgtcatgcactttgacaccctttatgaaaagctggatcaagcagatcttttattggttatcggcacgtctctcgaagtggctccggctagatttgtgcctgaggatgcaagtctgattcccggcatgaagaaagtcatcataaaccttgaaccaacgtattgtgacagcttgtttgacatggtcatccatcaaaaaatcggcgagtttgcccgaagtttgggcataaaaaagtgagccgccttatgcgcctcacttttttattcatgaacaggaaccattgtgtcctctaacactccgaaggaatagcctttttcttttaatttattgattagtaccggcagcgcgtttacggtagcgggaagatcatgcatgagaatcacattcgggaggcctgaagagctgtgttccatattttcaagctgctctaacacggccgtcacatactttgaatttcggtatttccagtccatgctgtcaatcgtccaatcccagtatacaaaaccgtctttctcaagattgcggatttgtgagggggttagtgacggtttgcttccgtagggcgttctgacaagagcggttttatatcctgtaatgtcctgcagcgtgtcacgcgcctgctgcatttcttttagcggagatgtcggtgtttgatagaacaatctgttattgtgggtaacgccatgtaaaccgagtgcgtggccttccttttctgctcttttcacagcttgtttgaattcgttcatccgcggtgacagcataaaaaacgtcgcttttacatcagcgcttttcagcacatcgagcaagcggtttgtaaaggctgacgggccgtcatcgaaggttaagtaaaccgttttatctcccatgtcctgctttgtctgcagatgttttatcagcagatcgggggagtcgtttttcagcttaaggctttccttctcatctcgaagctgtccgttagttgtgacagtgacttcctttgctttcgttgaactgttagaataacccaaaatcaccataagcaaaagcagcacacataaaactgctaaacttgcaaatttaaaagcaagcgaaactgcagaaggagaagcctctcctctcgtttgtcgcataacaatctctccattggcataaaatctctacataatgctgtacagcaggcagcttatgaagatgccttatgtttacaacctatgtattaccagtcaagtatacaggaataaaactggaaagcacatagaaaatttgtcgaaatgtcagattttaaggaaaaaataaactcctttccgctatagatctcttgatctttctgtttttcagcttgtccaatatggtagaattagtgataatgacagcttgaatgacatcagggacatctcgaaaagggagggcttttatgaaggttttagtcaatggccggctgattgggcgcagtgaagcatcaatcgatttggaagatcgcggttatcagtttggtgacggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggagcggtatacattcagacaacaagaggtgtggccccgcgaaaacaccagtatgaagccggcctcgagccgcagactactgcttatacgtttacggtgaaaaaaccggagcaagagcaggcatacggagtggcggccattacagatgaggatcttcgctggttaagatgtgatatcaaaagtctgaatttactgtataatgtcatgacgaagcaaagggcctatgaagcgggagcatttgaagccattttacttagggacggcgttgttacggagggtacatcctctaacgtttatgccgttatcaacggcacggtgcgaacacatccggctaatcggctcattctcaatggaattacacggatgaatattttaggactgattgagaagaatgggatcaaactggatgagactcctgtcagtgaagaagagttgaaacaggcggaagagatctttatttcgtcaacgacggcagaaattattccggtcgtgacgctcgatggacaatcggtcggaagcgggaaacccggaccggtgaccaaacagcttcaggctgcttttcaagaaagcattcaacaggctgctagcatttcataaatgaacgaagaaaagagcccgctttttacagcggggctctttttattttttaacaaatccaatcaaaatggagatcatcggcgatatatagaggaagaacgtaaacgggatgtagtctatgactggaacaccaagtgcgctcgccataaatgcgccgctgacgccccaaggaatcaatgggttaattaatgttccgccgtcctctaatgatcttgtcagaaattttcgctggatgtttcgtttgtcatataaagatttaaatgattgtcccggtattaatatcgataaatactgttcgcccgttgccaagttgacgccgatgcttgagcagacagttgctgcaacaagacggccttttgagcggatgcctttcatgacgccttccaatagtgcagaaatcaatccgattttctccatcaatccgccgagtgcaaaagcaatcataatgagagagacagagcccatcatggattgcagtccgcctctgttgataattttagcggctgcctcattgtcagtttcgaaagttgtgccattttgcaaagctgtcataaacgcctgcaggctgctgtcgggtacaaaaatagcagtcaaaattcccgaggaaataattccggcagtcagaacggggattactgatacccgttttattgccagcaaaacgactaagagcggagaaagaagggcccacggtgtcacgtttgcggcatcttttattctggttatgacctgctgaatattctcggttgaagcagcgtccgctgacactgatgaaccgagaaagtaaaacagaacgacagtgatgagcaaagctggaatggttgtgcccatcatatggcgaatgtgttcaaagatcggtatttcgcctattccggctgcaaagttggttgtgtccgacatcggcgacattttatccccaaaacaagcgccgcatatgactgcgcctgctgtccattcaagcggaacgctagccgcgctcgatacgccgatcagcgctaccccgattgtgcttacagttgtcaggcttgagccaacaagtgtgctgatgatcatacatgaaaacaaagcagtcaacagaaggtggcttggttcaataaaggatagggcataaactgtcacagtcggtattgcgccgctgtacatccaggcgccgattaagatgccgatcagcgctagaacaataattggctgtacgccgtttttgatcccatctacaatccctttttcaatactcttccaggaaaatccaaaccataaagctgctgctgaaagcatgacaacacttaaaaacagcgggatatgaggttctacatgaagcaagaataagcaagaaataataatgcataacatcaatataaataaaccgacggctaacggaaacgtcagctttttttgagaatccaaaataacaccccatatttatctttaatgcttttgtgcttttgggcacgaaagcattataacagaaaaaaacgaaaatctatgttttttcacaattatgaatataaaagaagtgagcacagggcgtgctcactttacaatcaggacgggtatatccgatttcgctgaaagcttttcacttacacttccgaatattagctttttcagcctgttttggtctctgcttccggttacgatcatatcggcagaaatgcggtttgcatgctcgattattgattcagccggatcgccttctaatatatcgatatctccatctgcctgctgttcattcagcatcattctggcttcggcgatgacttcttccgtacggtcttcatagatcattggctcaggtgatgttacatccgatatcagcggatcaggaacacttgtcatgcctccgctgatatagcttgcctcagctgcgggtctgggcgggtcgatgacggtctgattgtctttcatatcatgtgaatgggcgacggtaatagcggcatttaaggttttagcaagatcaatggctgcctgaagcgctttcttactattttcacttccgtcaaacgcaacaatgatacggtcagcatggaacatccttctcaccctttcaaagcgtcttacaacactactacccgaatttgagcaccattaaccttttcctattcaagtaatgattgacaataaaaggttttgtttatatgatgataaaaagatgaaatcagaatggaaggagggtttgctatgccaaggaatttgcgtgtttatcaaacagtttcatattggcgcggcaaaccttttgttctgttttcgtgaacggttttttaggtcggaccgcgcgctgaaaagcgctgtgcgtaacatatcggttaaaaaaggcatggagctgacgcttcatgccttttttatatacaaaatctaaggaaagacaggtgtatgggatgtgaagaccaatacagaggcgagggctgttcgtgccaaattggatgaaaaaagctgcaaggaaaaaatagaaggcggctgatgaggagatggggatagatgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaagcaggggcatttactgcggaagggctgctgttttatatcggtatcttttttgtgctgacggcggccgtgtatatcatgtcttatttttggatgcatcagctgtttggcggagcgaatctgatggagaaaattcttcgtacgaagctgatggggcatttgctgactatgtcgccgccgttttatgaaaaaaaccgaacaggcgatttaatggcacgagggacaaatgatcttcaggccgtcagtttaaccacagggtttggcatcttgacgttagttgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtaaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaatgtgatgcagcgcggcaatgcgtcattagatcgggtaaatgaaactctttcttatgaaacggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctccaggtgaagggagcattacattttcaggtgtaccgattcagcaaatccctcttgaccgtctccgcggatggatcggatatgtgcctcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcgggcagaaacaaagaatttcgatcgcgagagcactcatggcgaatccggaaatcttgattctggatgattcactttccgctgtagatgccaaaacagaggctgcaattatcaagaacatcagagaaaaccgcaaaggaaaaacgacatttattttgacacaccgattatccgcggtagagcacgctgacctgatccttgtgatggacggcggcgtcattgctgagagaggcacgcatcaagaactgctggccaataatgggtggtaccgggaacaatatgaaagacagcagctgttcactgcggaagaagggggagcaggggcatgaaaataggaaaaacgttatggagatacgcacttctttatcgaaaattgctgatcacagccgtccttttgctaactgttgccgtcggtgcagaactgactgggccctttattggcaaaaaaatgatagacgaccatatcctcggcattgagaaaacatggtatgaagctgcggaaaaagataaaaatgccattcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaacggagacaagagccgggcatatgctgccgaaaagctgactaagcaggaacttttccagttctatcagccggaaataaagggaatggtgttactgatctgcctgtatgggggcttgcttgtgttttcggtattctttcaatacggacagcattatctgctgcagatgagcgccaatcggattattcaaaagatgaggcaggacgtgttttcgcacatacagaaaatgccgattcgctattttgacaaccttccggccggaaaagtcgttgcgcggattaccaatgatacggaggctattagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtcggtcatataccggagatatgcgtcatattacaaccaaaaaatccgctcgatcaacagtgacattaacgcaaaaatgaatgagtcaattcaaggcatgaccattattcaggctttccgccatcaaaaggaaacaatgagagaatttgaggaattaaatgaatcacatttttatttccaaaacaggatgctgaatttaaactccttaatgtcccataatctggtcaatgtcatccgcaatcttgcgttcgtctgtctgatctggcattttggcggtgcgagcctgaatgcggcggggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacagaagaagcgggtgaaccggcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatcttctgtttcgtttttatgatgcgcaaaaaggtgatgtcttaattgatggaaaaagcatttacaacatgtcaagacaggaactcagatcccatatgggcattgtgcttcaggacccgtacttattctcgggtacaatcggatctaacgtaagcctggatgacgaaagaatgactgaagaagaaataaaaaatgcactgcggcaagtcggtgctgagcctcttcttaagaagcttcctaaaggcattaatgagcccgtgattgaaaaaggcagcacgctatcctctggagagcggcagttaatttctttcgcaagagctttggcgtttgatcccgcgatcttgattttagatgaggcaacggcgcatattgatacagagacagaggccgtgatccagaaggcgcttgatgtcgtcaaacaaggacgcaccaccttcgtcatcgctcaccggctttcaacaatcagaaatgctgatcagattttggttcttgataaaggagaaattgttgagagagggaaccacgaggaactgatggcattagaaggccaatattatcaaatgtatgaactgcaaaagggacagaaacattccattgcataacgctcaaaaacccaaaacaatcgtgttttgggtttttggtttatgtagtcaataagccagtccgacacggtatccgacatactcacctgtaacgagctcacgatataaaaagtccgcagtatcgccgaccgaaatgcttgtgccgccctcaggcaaaacgttacgctccgtacgatatacgccggttgctgttccgtccgggaggtaagtggggcagatgattgtccagtctaatgatgattctttaagcatttcgtatacttttgcatgctccttggctgcgcgggtctgctttcgtttcgattcatttgtttcaaatcggtattttcccggttcatatcgggaatctaggatccctgcggtgccgatcgtaataagccgtttgatatgctgttcctccatagcggagagaatgtgtgccatagcagttgacaaggtatcatcaccatctgtgcctagacagctgatcacgatttcagcattctccattatttttttcacatcttctaagcggcgggcgttccccatgatggttctgtcttttgaaaggggaaaatcagcatgttgagatctgatcagagcgaaaatatcaaatctttcatctgctgcagcttgtgttaaaaaggcttgtccgacgcggccgctggctcctaataaagcgattttcatcaaaaaacctcctcgcctttcattataaaaggatgttctcagtttgaacagcgcgggaaagaatacctgtacaaataaacagaacgatgggaaacatattcatgaatcatggatacacttacgaactgaaccagctcccaattcacaatggtgatgaatgacaccccgattccctccctttttttctaggatatgtggagcaggaaaaaagggtgacaaaataaagagagcgcggaaaccgcgccctctatagccatatattgaattgttattgaactctgccgcccatttgctgctgagcgaaagatactaaacgttttgtgatttctcctccgacagaaccgttagcgcgagaagttgtgtccgctccaaggttaacgccgaattcagaagcgatttcaagtttcatttgatcgatagcctgagctgcgccaggaactagtaagtcatttgaagagttttggttagccatgtgtaaaatctcctttttatttagtatggttgggttaactggagttgcaccaatctgtgaacccttctcgggtgtcactgccgcctcggcgtaacccaatgctttgccggcttgttactacgtattatgttaaaatggctggaaactcatgcggagaattgtgtggtaaatcttgagaaagcaaaaaaagcttagccgtttaggctaagctagtcataaatatgaaaaagcatcagttcatgtatctcgtttgtaagagcaggctcgtcagcgcgggcgggaaacaagtctccccattcaatctcaccgctcttatgatagatgccttcataatgggtccctttataataaaatgaaattttccatccgggcagcttttcttttgggaacaaaggtttccagctgaaatgagaaatcattacggccacgctccttacatttggtatcaattgacctgaataaaaacggcttatgttcattgtatcattgtttcagaacatcattgaagaggccttaatatgcagattgtcccagctttggataaagataagcccgctttattaaaaaagcggacaggttacgaaggccacaatgcttcaggagatgtgattgccttctcagataaatatgacgcgtattcaaagcttcttcgttttgtaagagaatcaacatgatgcaaatttggatgagaaaaaatgcttcggcctgggcgcgaattcgcttcaaacatccatactttaccgttctgatcaatgccaaaatcgaaaccaatctccccgataaacccctcgatatgatcatgaaggacatggcttgccgtcagtgccgctgcagaaagcttttttatgacctcaactctttcagcgggatcatcgtatacttccgcaagtgtctttacagtgccgccgttagaaagatgtgttgtaatgctgttctttccggaaatttttacggcgattgctgtcactgtccattttccttttctgtttttattggtatggacacggaaatccgctggtttgccgtgaaattcgatgagatcaacaccttgctgaatgagaaagtcggacgtgttgtgctgtttttgaaattctgcaaggaatgaggcggcatcggaataatcaatcgaagtaaatgttttggcgtcattcgtatgctttaccgtcaggccgccatctgttcttttcagctgataaatgccggtgccgagtgctccatttgccggtttgatatagacttttttgtatgcgccacagagctcatctatcagctccacagacggtgtcagctcggatctaggcaaaaagggtgccgttctcggatctttttcgagcaattgatgaacgttccatttattgaaaaacgttttattaaaccatgggatctgatattcatcgatcagcctcttttttgtatgttgcaagagaagtgaatcttcaatttttcggttcggcaaacggtcataaacgacgttcggcaatggaacgatttttttctcccagccgttttccctgtaaaggaggccttcaatcgtgccttcctcccaattgatttggtgcgcgccaaaaacgaagcagtagcctccggcttgctcgtgtaacgtgacaagcttagaaaaaaagagggaacgctccttaaatggacgttcaagagatacagtaaaccctgccgtaaagatgccgactaacggcccgatatgcactgtatgatcatgaatcagtatatcagccctgcttcggtgggggagcaaaagctcatgaaacagattttcagagagcagcacggtttgttccagatgccgtctgtaagcaacgtggcatctgacaaccttcgttccgaatgcggcatgcaaaagtccgtctcgcttcagcgaagagggcagaaacagggtattttcactggttttgtctatgccgatcaaaaaccgtttaggattcacgcggaagaactcctttctggctttgttcagaaaacagatattggcagcgctttaggggacaagtgtacagctgttctttttgctcgggagagacacgtaagattgacttcctgccaggtttggaattgatatctaaaatccaaattctcccgtccttagcaagacatatatcaagaccgagttcaaataacggcccgtagcgctcgtcaagataatacggaaccgattgggtaatcgaaaacacatcatctagtaaaaccacttgctgttttttcggtatatcttcaaaccaggagtcaaatgtcagcgcatcagatccgcctgacaaattggccagcagcccgtgtttgtatccgcgtcttactgcctttccgactgtattccattcacctgcttcgtttttttccataaacagacgaatatcacaagggtattgttccttatcttgaatgtttaagtaaggctgaagcaaatattgatgctgaagcacttttttgcaccatgttttaaaagaagtctggttggaaaacgtttttgtctgcttatcctttccgatgtgataagtagcagtgatgtttttcttgcccagcttcaaaagaatcacgcctctgcctcccgcgccgaatgccggtttaaggatgcaggctttttctttggataaaaaggattgaatttgttcgtagcggttcacctttatcgtttcgggaatatagggattgattacagagtgctgctgcaaatcgtgaaggacggtccacttatcgggaagaccccgcccgataaattccgttttcggatattttttgagccactcaacgattggttttgctttttgggaatgtgaatccttgccgtaaaaacagcgatcataaatataatctggaatcgccatttcagtttcgttccatgtgctgctggccgaatgatagaccgatgctttgacacgcaaagtgtcaggtaaaatatcaaatggtgtaaaccggatgaaacgtatgccgaattcgggtgctcttttggccagttctgcggaataatccgcttcatgctggcgggataaggacataaaaccgagtgttatcatggtgagactcccccttttattcaaaagctgccggcgggtgtccgcagctttacactaaatacatgtaagacgaacgcagctgacggtattctactttacagaatacgattcttcaccttgccctattccaaaagaacaagctgattttctaagaacaggaatttgtctcctcgtttgctaagtgattgcatgagcctctataatacgtataggtacataatctatatgaaaaaagctgaagcacagatggaggaagatgaataggaatgggtattgcaggaacctttatttttatgatcgtgatcggcgctgccattggagcggtgaccaatcatttagcaattcaaatgctgtttaggccgtataaagcgtactatttgtttgggaagcgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgccccgaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtccgttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcggaatgaggaaacaaataaattgctttctgatctcttaaaaaacgaatggggcaagctgagggagtatacgtttaatgaagcagacgaaaaatggaatgcaaaggcgctcattttcagtttgaaacgaagaatgctgcaagcattttcgactgcccctttcttcaacaatacgattggcacgcttaccgtccgctatgaatctgagctgacccagcaaatgctgccggcactgttagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttggggggccttctcggcggaattataggcgcgattcaagcactgtttgtcatccttttttaagaagaaatgggttctgattaatgaaaggatctccatagtctgttatagtggagtggtatgtcaaacggcaatgatgaaaggagctatttacaatggctgttaatttttatgatgtagcgtatgatctggaaaatgcattacgcgggagcgaagagttcacccgtttaaaaaacctttacgacgaagttaacgcagatgaatcagcgaagcgcatgttcgaaaacttccgtgatgtacagcttagactccagcaaaaacaaatggcaggagaagagattacacaagaagaagtgacgcaggctcaaaaaacagttgcgcttgtacagcagcacgaaaaaatttctcagctgatggaagcggagcagcgcatgagcatgctgattggtgaattgaacaaaatcattatgaagcctttagaagagctttacggcagtgttgaaggctaatcagcaaaatcccttcttggataagaagggattttttattcattcagcaaacttggaaatccaatgaatcttttacctctccattgatgatgactgataatgtatgaattcctttgtaatgctttctggtggttaaatccttaaaggattggattcttgtgtatgacttcgtttcgttttttcgtatatttgtttctgttattttaaatactttctgatgacgctggcctcttgcttttacaaaatcaattgcgtactcaattcttactttttgatccctgtctgaatgaatatagaaagaaaattcaaggctttcgccaataactatacgtttgggctggcatgttaaatcatgtagttgtatcgaatcagcattttcataaccaaaaagcgctaaggcctgtttatcacccttttttaataaggtccgataggcgtgtttgataatccagtctgtatggggatgtgttccgtaccattgatctgcgacttttctcagtaaatgaggatgcgtttttgatatatcattaaggttgttggccacgcttttccttacatataaggactcgtcctgcatcagcttctcaaggatcggcaatacgggggaagggtccgatttcaaagccggtatcgattttccccatggcaggcggggcctgctgccttcgctcgcaagtcttctcacgtgttcatttttatgctcagaccatgcaagcaattgtgcaatcatcttttcttgatctaacagcaaaaaaggccttacagcaaattctgaggtcgaatattgcgtaaagtattccaatgcctttattgattcttcccaatgcgctaacccgtactgttccacataatctggaaataaaattccgctgagtcctttaaaatgaggggctgtatcccgtaaaattgtgagcgcttcaacgtattgttttggcaaagtttcgtataaagaaactgtcacgcggcgcatccgctcttttaaagtgagttcaggccagtcctccagccgtaatgtatccaagaatctgtttttgttaaaatcaggataggatgaccttacatgatggatcaactgagatatcagttcttcattatatatttcttttaaatcagccatataaacaccgctttttcgtttattatttatattgtatgggaatgtacgttctggatcaagtgtatagtcctaaaaattaacaactgatcctaccacggatatacaaaagttggttactttttttagttaaaaaaacccttgtcatcggaaaggaaaactgagataataacattgaaagcgcctacacttacctatttcaaatggatacggtcgcatatcatgccgttatatagaggggataagcaacagagagtaagtgttcggagcgcatcattggtcaaacaaggggttccttatacatgatttttcgtaaatcgaaataacgatattagggagaatggctgcttcgatcgtatcctatcaacaagccatacataaagtctgctgagccaggctttttttgctttaagaaaaggttgttctaaacacagagacagggtcatatcctatacacaagtacagtcatcaaggagggggacatctctgtgtcaaaacaattgcttgccttaaatatagatggagcgctgcttcggtcgaacgggaagattcatcaggcaacgaaagacgcgattgaatatgtaaagaaaaaagggatttacgtcacacttgtgaccaaccgtcattttcgctcagcacagaaaatagcgaaatcgctaaagcttgatgccaagctgatcacccatagcggggcatatatcgctgagaaaattgacgccccgttttttgaaaaaagaatttctgatgatcatacctttaacattgttcaagtgctggagagttatcaatgtaatattcggcttcttcacgaaaagtattccatcggaaacaagaaaaaggtgaattcgaatttattggggaaagcactcattcatccgtctgacccgatcttttatccagtccagttcgttgaatcattaagcgatctcctcatggatgagccggtgagtgcacccgtcatcgaggtgtacacggagcacgacattcagcatgacattacagaaacgattacaaaagccttccctgcggtggacgtgattcgcgtaaacgatgagaagctgaatatcgtcccgaaaggtgtctcgaaggaagcgggtttggccctcgtcgcttcagagctgggcctgagtatggatgatgtcgtggccattgggcatcagtatgacgatctgccgatgatcgaacttgccggtcttggggtagcgatggggaatgccgttccggaaattaagagaaaggcagattgggttacaaggtccaatgacgagcaaggtgtcgcttatatgatgaaggaatatttccgaatgcagcagcgaaaaggatttcttgataagttccacatgaaacgtgtgtaaataagccgctcgcgccctgacaggtgcggcggcttttttgccggattgattttagcagtttatttctgtacactaaagaaagttttgaatctgataaattaggtgatgaagttgcaaattaaaatagaaggcatacatgatgaccgcctgcatcggcctctgcaaaatattgcaaatttgttttatgaagagtgcgagcttgcgtatggcggagaggagcccgcagattttgtcatttctttagcgttgtcacaaacggatgagcatgtgacggtttcgggagaagtgaagggaactggcataaaggaacagcatacaaaattcttttctcccggcatgaatgaaaaagaagcttttaagcaagtgaaaaacacaatttcttatgtgtatctcaatcttcttcaggcgcatacgggcattacgcagaagtggggaatcctcacaggaatccggcccacaaagctgcttcataaaaaactgcaaagcggaatgtccaaggagcaagcgcatgctgagttgaaaaaagactatttaattcatgatgaaaaaatcatgctaatgcaggaaattgttgaccgtcagctggcggcagttccggatttgtaccgagtaaaggatgaagtcagcatttatatcggcattccgttctgcccgacaaaatgcgcgtattgcacattccctgcgtacgctatccaaggacaggcgggcagagtcggctcattcctatggggactgcattacgaaatgcagaagattggtgaatggctgaaggagcatgatgttaaggttacaaccatttactttggcggcgggacgccgacaagcattacagcggaggagatggatctgctgtatgaagaaatggtccgctccttcccggatgtgaaaaacattcgtgagattacggtggaggccggtcgtcctgacacgattacagaagaaaaactcgccgttttaaacaaatatgacattgatcggatcagcatcaatccgcaatcctacgaaaacgaaacgctaaaggcgatcgggcggcaccatacggttgaagagaccattgagaaatatcatctgtcacgccagcacggcatgaataatattaacatggacttgattattggtttgcctggggaaggcgtgaaggagtttaggcacagtctttcagaaacagaaaaactgatgccggaatcccttaccgttcatactctttcatttaaacgggcgtcagaaatgacgagaaacaagcataagtacaaagttgccggcagggaagaggtttctcaaatgatggaagacgcggtagcctggacgaaagagcatgggtacgtgccttattatttataccgccagaaaaacattcttggaaaccttgaaaacgtcggatactctttgccgggacaagaaagcatctacaacattatgattatggaagaggtgcagacgattattggcatcggctgcggcgctgctagtaaatttattgatcgggatacagggaaaatcacgcattttgcgaatccgaaagatccgaaatcgtacaatgagcgcttcgagcactacacggacgaaaaaatcaaatatttagagcagatttttgagaagacgacaaagcagcactgatcacagtgctgctttttttatccctgtttttttgcgggctgaacctcaggcttccatttaaataccttgttcagcaagcggtaaattcgttttgattcctttgttacaagcggtcctaaaatcgccagaatgaggacatataatgcggcaaacggctttaatgtggccgacagtccgccggctattccgagattcgcaacgataatcgaaaattctccccgcgatacgatcgtcagcccgatattcgatgaagccttatgagaaagccctgcgcgtcgtcctgccaccattccggcgataaaatttcccagaatggtcaaaatcactgcacccaacgcaagccaaaccgcttcaccaagcgaaaacggatcgatactgaggccgaagctgaaaaagaacatcgcaccgaagaagtcgcgaaacggaacaacgaggtgttcaatcctatcggaatgctctgtttctgaaaagaccaaaccgagcagcagcgcgccgattgcttctgctacatgaatcgtctctgaaaacccggcgataaaaaagagtgctgcgaaaatgacgataataaacacttcgtttgagcgaatgtccaacagtttgttcaacagcggcgggagttttcttgctgcgataaaaaacagcagcatataaccgaaggcgatcaaaatggacaagagtgcactccctacggatgtcgcatcacctagtacaaggccggaaacaacggacagatatacggcaaggaaaatatcttcaaacatgatgatgccgagaatcaattcggtttccggattggcagttctttttaaatcaacgagcacttttgcgacaatcgcacttgatgagattgtgatgacgcctgcgaggatgaggacttccagaaaggaaaatccggtgataaacccgtaaagcagtccgaggctgaagttaatcaaaatataaatcgtcccgccgaccgcgattgattttcctgatttgattaacttcccgacagagaattcgagtccgagatagaagaggaggaacagtacgcccattcgcccgaaaaactcgatgatttcactgctttgaataaatgttagatcaataatccccattttcggcgcgtgcggtccaacaagcattcccagcacaatcagaaacggaataatcgaaaatttaattttattggcgatcacactggcgattgccacaaggacaagtgcagttccgacttcaaatacaagatggtccatcggggctcacacgccctctccagaaagaaaatcgtgaatcagtttcttcagatgctttctctcacctgagaggacaagggtgtcattttcttcaataatcgaatccgctccgggatttaggagcttttcctggttgtgtttgataatggcaatcacagtgacatcgtaattctggcggacatcaagctctccgagtgtgcgcccgatcgatttggcgcctttttcgaccttaaaccattcaataataagatcgctgaaggccatttcgatggactccagagcttgcggtttatagaccatgcctccaagaatagctgcaatttgccttgcttcagaatcatccaatgaaatatttgaaagaagctcatccgggtcccggtcattaaaccggtaaatttcccttcttccgtcatcatgaatgataatcgtcattttttcgtggcttcttgtttcgatttcaaactttttgccgatgcccggcagatcgttttctttaatattcaatgaaaatccctccgaatgtagtgttggcagtatggggtgagttacaaataaaacttgagcaaattatattcggaggtagttagactggtatttgacagggacggccaaagccttttccagcctgtttatcagcggttcgtcaagtggtttgacagagagctgcctgacagactgcgccagcgggctgtactctttgatcagctcagccgggtgcatgctgcccggcgatggcgtttttgccgattgtgtttcctgcggatatgaagacataggcacatagctgtcagtgcttgcttcaaactgggaaggcagaaccacgtccgaagggggaaagtacaccataaataaacttaacagaaaactgatcagcaatttatccatgttcctttcctcccttctcatcaagatatcccttctttttcactatataaaactttatgtttccattcaaacaatatgcatttttcagtatctattgaccttgaaaaataaaaaggtttatttggggatggcggggaatgtataggagaaagaaaaagtaagcgcatacatggaggtgcttttaatggagtttgttcaatatgcatgtaatggggccgttgcagagattatcctgaatcggcctgatgcccatcacgccctgaatgaacagatgctgtctgaattgaaggaggcagtcgaaatggcggctgcaagcgaggcgctcatcgttctcctgagaggaagcgggaaaggcttttcggccggcggtgatatcaggatgatgacgtcagagcatgaccctgaccaatttaaacggctgatggatacgattgaggctgtcaccctgaatttatatcagatgaagaaagtgacaattgcagccattcatggtgctgctgcgggactgggcctgagtttggcgctttgtgcggacattgtgctcgctgaaaaaaacgccgttctcgcgatgaattttatcggcattgggctagttccggacggcggaggacattatttgctgaagaaaagaatcggtgaagcaaaagcgaaaaaactgatttggagcggaaaaaaactatctgcctcggaagctgccgatatggggcttcttgatgggacatttgccggagaccctgccgaaggcgcaagacccattatcgaaaccctgttggcctcccctcttttggcgatgatcgaaacgaaaggtatttttcaaagcctccaaattgaagaactgaaaaaagtgctatcccttgagcgcagcgcccaagagagaatgagaaggaccaaggatcaccaagaaggaatccgtgcctttttagaaaaacgggagccgaagtttcaagcgtaacagatcagccggaaagctgatcatctgtgaaacaaaatcagctttccggctgcattgactaaacgatgagtatgactatgaagctctttttcttttaagagggcttcaccatgcgtttttgccgcttcttcatgttctgcctcgaattgctcgtttaccagcgtgttccccgaaggatcaaatacggtaaggaaataatcagccatcaggtttctcctccattttaaggtttatcagtctttcttcatttatattctaaaaaggaaatcaaaatcctttattatgctttatccaaaattagtatataatgggtcagggaaggaggagattcagtgcttacaattgatcacgtaacgaagacatttggagattataaagccgttgacggattggacttagatattccggaacagcaaatgttcggtctattaggcgcaaacggagcgggaaaaacaacgacgtttcgcatgatcctaggattattaagcattacggagggctcaatcaggtggaagggccgtcctgtgaattatcatatcagcaacaaaatcggttatttgccggaagagcggggcctttatccgaaaatgaaggtaagggatcagctcgtctatcttgccagattaaaagggatggagaagcgggaggctgtaaaagagctcggtacatggcttgaacgcttcaatataacagattacgagaataagaaggtggaagagctttcaaaggggaatcagcagaaaatccaatttatttcagcagttttgcataagcctgagctcctgattcttgatgaacctttcagcggcctggaccctgtcaatgttgagctgctaaaagaggctgtgatctcgctgaaaaacagcggcgtttctattttattttcaagccatcggatggaacatgtggaggagctttgtgagaacctttgcatattgcagaaaggaaaaccggttgtacaaggcaagctgaaggagatcaagcgttctttcggtaaaaagaatgttaccattcactccgatgacgatctgcgctttttgcagtcccatgaaggcattcttcaatggaaggaaacggcagacggcgtcaagctgcagattgccaatgaagacatttctcaagagatttttgctatgctccaaggaaaagggtttatcagaaagtttgagcttgaagagccgtcactgcatgatatttttatagaaaaggtgggggccgtctatgaataaattttggatcatgctttctcatacatacaaaaataagattatggcaaaatcctttattatttcgactgtcatcacggtgctgcttgttttagttgtaacgaatctggagtcgatcatttctttgtttcaaggtgacgatgcgaaagaaaaaatcgccgttgttgatgaaacaaacgaattatatccggttttttctaagcagctgaaagcggtggatactgacggcgatcttgatgtgaagctgtcgaagcaatcggaggatgaggtcacaaagcaagtcaaagatgaatcactcgatggcatgctcatcatcaaacgagatgaaaaagggaccatttcaggaacatataaagcgttaacgatttctgatgaaagcacgtatcaaacgctgcagcaggcgctgacgcaaaccaaaacagctgtcggaacagcggagctcggcgtgtcgcaggaaacgattagcagcctttatgcgcccgttactgtggggcagaaggcgctgaaagaaggggcaaagtctgaggaagagcttggccagacggtagggcttgtttacattatgctgttcgtcatttatttttcggtgattatgtatgccagcatgatagcgatggaggtcgctacagaaaaatcttcgcgagttatggaaatcctgatctcaagtatgccgccgatccagcaaatgtttgcaaagctgcttggtattgggcttgtcgggatcacacagcttgctattattataggagccggctctctgtcgcttaagctgaaccaaaagagcgaaacggcttcatctgtcggcggattccttaatttgaccgacgtatctgcaaccactgtcatctatgctgtcattttctttttgctcggatactttttgtacgcgacacttgccgcgtttcttggcagtgtcgtcagcagaatagaggacgtgcagcaaacgatcacgccgatgacgcttttggttgtcgccggttttatgatcgcgatgttcggtttgaatgcgcctgacgcaggatttattacggtaacttcgtttattccgttctttacgccaatgattatgttcctgcgcgtcggcatgcttgatattccgttctggcaggcggctgtcggaatcggaatcacactgctcaccattgtcatactggccgttatcggcgccagaatttataaaggcggtgtattaatttacggcaattcaagcgcgttcaaagcgatcaaacaagcgctacgtttagcgaaaaactgattggaaaacagcctggggattctcaggctgtttcttttttgacagaacgtgcattcgcaagaattcggtgctaaaataagggtacttcatcctggaaaggagcagaatgttgactgatctaacctttattcatgcggcagatcttcatcttgacagcccgttttacgggatatcgcatctgccggagccgatttttgcccggattaaagaaagcacgtttgcaagcgtgagacatatgatagacgccgcagtgagagagcacgttgatttcattttgctggcgggagatctgtttgatgaagccaatcgaagcttaaaggctcagctctttttgaaaaaacagtttgaaagactcagagagtgcgggatttcggtatacgtcatctttgggaatcacgatcatcttggcggggagtggacgccgattgaatggcctgagaatgtccatattttttcgtccgctgttccagaagaaaaatcgttttttaaagaaggcaggcgcatagcaagcatttacggcttcagctatcaagccagagcagtgacggaaaaccaagccgcccgctatcggagatcaactgacgcaccgtttcatatcggcatgctccacggcacgctgtcaggatctgaaggacacgatccgtattgcccgtttacacatgacgacctcgtgaaaagcgggatggattattgggcgcttggccatatacataaacgccaggttctatctgccgagcatccggcagtcatttacccgggaaacacgcaagcacgccatataaaggagacgggagataaaggctattatctcgttcatgtgacaaacggagatatatcttatgaatttcagagagcgcatgatgtcctgtgggaaaaagcggcggttgatgtgacggaggcaaagaatatgacagccctcttccaaatggtggaggacacgttttcgaagctgcggaaaaaggggagccctgtttgtgtaaggcttgttttacaagggacggcgccggaatggctgctggaggcgccaaaaggcaccttggatgagtttcttgaagctcttcaggaacaagaagcggaagaggaacatttcgtttggcctcttagattggacgatgagacagaaaacgaagcaaacctaacaaaccttgatcctttttttggcggtttatttgaagacattgatcgcagcgatctgtcagacgtgctggaagggcttgagcggcatccagtgtatagaaggcacgcggaccggtttagccaagaggaggtaaaggaaataaaagagcaggcacagatattattgaaaagacagcttaaggtgcttgatacatgaggcggtgacagctttgcgaattatatctttacatatctaccaatacggaaaattttccaatcggacctttcacttttccgcctctcctgtccaagtcatctacggattaaatgaggcaggaaaaacgacgatgatgtcattcattgaaagcatgctgttcggttttccgaaaacgaaaaaatatgaaccgaaaacaggcggtgtctacggcggtgttcttgaagctgaacatcctgagtatggagtgctgaagatcgaacggacgaaagggactgccgaaaaactaagcgtgtacacagaaaagggcgaagtaaagcagggagatgttttaaagcagctgttccagggcacagacaggtcgttgtacaaagccatatattcgttcgacgtattcgggctgcaggaaattcacgcctttaatcgggacaagataggggaatttttgctcttttccagcttgtttggtgctgaagccgtatcaaagcttgattcaaggctgacgaaggaaagcgaaaggctctataaaccaaatgggcgaaaccctcaattgaatcaggagctggaaacgcttaagcagctggcagtgaagctaaaacaggctgaagcagaggaagcgggctatcatcagcttctcggggaaaaacgaatgcttgaagcccgccttgcagccgcggaaaccgaattgaaagagacggcgggacatatccgaatgattgagggagcgattgagcgaaaaccattgctaaatgaaaaagcgacactcgaacaggtgattgcagaatttccggaacatgcaggacaatttcctgctgacggcctgcatcagctggaaaaaaatgaatcccatcttcacccgaaatcagcacagcttgaggcgcttcgggtgaagatggcggagttggacaaacagaggcaaaagcttatccccgataaagaactattggcgaaagaaacgctgatacaagagctttcggcagcgtttcatatgtaccaatcctggggagaacaactggcagccattcaggcacagctgcgccagacgtctgcgcagacagcggcagggctggaacagctcaataaaacggatgaaaatgagctcctgaatatgaacacctcatatgattatgaatggcagcttcagcaagcggtgcagcaatatgtacaggcaagagacagaaaacggcagcttgacgagacatttgaacttgcccggcaagagctggaagacacggaaaaggccgttcgtgccgcttcgtccgcgattcttgaagatagccaaagaaaagataaagaagctgctcttagagcatatgatgaaacacaggggcagcaccaagagcaagcgaagctcagagaacagctaacgttttttgaaagacagcaggctaaacagaaaaagactgtcattgcagctggtatgttgttcatcgttctcttttctctgctgcagcaatggattcccgccataagtttcggcgctgcacttattgtgtattggcttgtatcaggaaaatcgtcttctcgaaacagccgagagacaagacagcccatgacggatatttcaccagcagaagctgaaatgcttagagaagcgttatgggaggatgaccgcaataagcagcaccttctcacacagcgtgcagcgctccagcaaaaagaggcggcgtatgaaagggtcatccagcagtttgaacagtgggaagccgaaatggcgccgtcctttacacaggttgagcgttttatgaatgagctcggatttaaggaagatccatcatttttgcttgatgcatacagcttaatgaaggatgttaaaaaagaagtgaagaaaaagcatgagctgaccattgaagcaggcaggctgaaaaagcaccggagaacattcgaagaacgcgtcagtatgcttcttcccgtgaatcagagtcaggatatctccatttcggacgcccttcacacattgcggaaaaacattgaacgtgaaaaagaaattgagaagcaaaaaaaggaaattgaaacagatattcattatacaaaggaacagatgcttgaacttgagcaagaaatacagtatttccacgcacagatcgaacagttatttgtcgcggctgctgcaaaagacagagatgcgttttttgccatagccgacatcagcaggcaattgaaggatacggagaacaagcttcatcacgtaaacgcacagcttcaaggcgggtacccggaggaacttgaactggcggattccaatacgctttctgaattgaaagataagcaatttgttgagaatgaaagaaaagagcggctgactgaggagatcgagcagctccgcagccaaatcgcactgctctcagtcaaacaggaacaattagaggcttcgggattggtctcagacctcaagcttcaaaccgaaatgcaaaaagaacgtgtaaaagaaacggctaaaaaatgggcctcgatacaaatggtcaaacaggtgatcagaaacaaattggagcggcataaaaaaatcgagcttccgcgccttctagagacggcaggagaattcttccgccctctgactgacggaaactaccaaaccatttatttttccgaaacggatgattcgatcatggttatgcatcgcgatggaactgtctatcatgcggaagagctgtcacaagggacgtgtgaacagctgtatacagcgatccgatttgctttggccgttacgcgccagggtgggtcaaagcttccgttccagcttgacgacagttttgttcattttgatcaggaaaggctgaaacgtgtattacatgttctgtatgatttatctgaaggcggtaggcagattttgtattttacatgccatgagcacgtaaaagatgcatttcatagcagccaaatcatccatttggtgtcataaaagaggttctatagctgaaaatcggtatgtgatatactggtattatgtaagatacggagggagctttaatagaatggctaaagggattatgctacatgaggttggcgaacaggtggaccagtatctattgattaaatcctcgacgaaagggattgcaagcaatggaaaaccgtttttgacgctgatgctgcaagaccagtcaggcgatattgaagcgaagctgtgggatgccaagcaaagtgatgaagtgacctatgcgccgcagacgattgtcaaggtcgtcggcgatgttcatcattatcgcgggcgcacccagctgaagctaagaaatatcagaccggtaagcgagcaagaaaacgtcaatatagatgattttttagaaaccgcaccgattccgaaaaatgaaatgatggataccatcactcaatatatatttgaaatgaaaaatccgaatatccagcgaatcacaaggtttttggttaaaaaacacgaagctgagtttatggattatccggcggctacgaaaaaccaccatgagtttgtctcaggtttggcgtatcatgttgtctctatgctgaacctggcgaaggcaatagcagatttatatccttctcttgatcgtgatctgctttacgccggtgtcatcctgcatgatcttggaaaagtgaaggagctgtccggccctgtttccacttcatatacggttgaaggcaatttgcttggccatatttccatcatggtgacagagctttcaaaagcggctgaggagcttcaaatcgattctgaagaggtgttaattcttcagcatttgattttgagtcaccacggcaaagcagaatggggcagcccgaaaccaccgatggtgaaagaagcggaaattcttcactatatagacaatctggatgcaaaaatgaatatgatggacagagcgcttgagcgcgtgaagcctggcgagtatactgaacgtgtatttgcactggaaaaccgttccttttataaaccgacatttcataaataacgtaaaaaggactgatgctgacatattcagctcagtcctttttgatgcgtctttctcgcacataactcgtctcattcccgcatatggttaagaataaagaatctatgcaaagggggaggagcccgtgttattttttccatggtgggtgtatctttgtattgtaggcatcattttcagcgcatataaacttgtggcggcagccaaagaggaagaaaaagtagaccaggcttttattgaaaaagaagggcagatttatatggagaggatggaaaaggagcgagaacgccgcagttctcagcagcatgaagaagaaaatcaaaaccattccatcgcataaaaaaagctgtgcggctcaatgagcctgcacagcttttttattatttggaactgcttgaagatgaagaagtgctgttgcttgttgaagatgtattaaatgtgtctttcagatccttatcttttacttcgatgtcagccttcttcatgactttttgaacagcttcctgaacggcattgctgtcatttagtttttgttcaagcacttcagatttcagttcttttttcatatcatcgtatttgccgcgttcttctgtctttttaatgatgtggtagccgtattgcgttttgacaggatcactgacttcacccgtttttaatttgaatgcaactttgctgaaatcagctatcataccgtcttttgcgaaccaaccaagatccccgccttttgaagcagagctgtctgttgagtattctttcgcaaggtcttcaaacttctcgccttttttcagctttttctctacttcttcagctgtctttttatcagcaacaaggatgtggcttgcacggattttgccttttaagccttcccagtactctttgatatcggcgtctgttactttgatgttatctttagccgctttttgtgtcagcaattcatattttacttgttcttttaggtaatccttgccatattgcttttcgagggcagtatattgatcgccaagctgcgttttgtattctttcagcttgttgtcaatttctttatccgaaactttatacttcttgtccaatactttttcttgcactagctgtgtcagtacgcttgcgccagctgttttcttcatgtttgtgtaaagctcgccttttgtgacatcgcctgcgtcagtttttgcgatgacttctttgtcgccgctgctgcatgcactgagagcgaggatgcttgtagcagtgatagctgctattgcgattttcttcattgttttcaaacactcctaatcattccaaattaaattacctatgcgtatcataacatattgtggctttctgtaaaaagattttaaataaagggcattcgtctagtcaaacttttgctgatgacatacttatatattgatcaagaaaaggaggtatgtaacatgagcggaggatactctaacggattcgcgttgctcgtagtactgttcattttgcttatcatcgtaggtgcagcttacatctactaagcagaccgaggatcgcttgcaacataagcgatcctttattttcactagcgcctaatcgtttcaaacatgaattgcataacatgtaattggtaaataaagcttattacaggaggtgctttttaagatgggtgaagtatttgcaggcggattcgctttattggttgtgttatttattttattgattatcatcggcgcttcttggctgtactaatcaacataaaaaagcatagctgcttaatcagcagctatgctttctttcgtatttacactgtaaaggagatctccacaaacgaagagatcagtaaaattaatatagatacattaataaatcggaataccttatcttgccgctcttcaggaatctctctgacaaggcataatgtattggtgagcctgtttatgaaatataaaataaacacggcagccacgataaaatagaataaaatgatgggagattccccctctctctgaactgtcccatattacattaccaaatatttattaaaaaagatagaatgcaaattgaaaaatcgccaccagcaccagggtttgactacttttcaacaagaatatccaagccgtcagcttcctgatcaataaaagcggttttcggtgcttttatcagcttgagagccagcaggaaatcaggcagacagtagccggcgtgaatgcccgagatcatgcaaaaataatgagcgtgattcggaaatgccagtgctgcgtaaaacaataccggtgtaatcagcaagaacgggctgacgagtgaaatcagcattgttgtttttggtatacgtttccatgtgcgcatgcgcaatatgtaaaactttttttctatttttctttttttgcagatgattggcaggacatggatgactttatgtacaaataaaataacgacgagcaaaccgccgaataaagatacatattcatcgcttaagcttgtgccaggccgcagcagctcaaaagctaaaaaggtagatataaaaaccaaaatcataaaacatacagcagttaatattatgcgaacggcgccataatccttcatgagatttatggtcttccagcaattcatcaaagtcatccttccatacatcttgaatagaatctcaaaataatttactcctcccaagagaaaaaatcaatgcttttttaagaaaaaatatcatccggcaggtatttttttgaaacaagcaaacaaactgcgaaatatggggttagaactttcttctcagtgaattatcagctaaaataagattaaagatagaaagaagtggtgtggatggattcgatggatcatcgcattgagcgattagaatattacatacaattattagtgaaaacagtagatatggacaggtaccccttctatgcgcttctcattgacaaagggctgagcaaggaagaaggggaagcggttatgaggatatgcgatgaattgtcggaagagctggcaacacaaaaagcgcaaggatttgtaacctttgataagctccttgcgctttttgccggacagctgaatgaaaaattagatgttcatgaaacgatttttgccctgtatgagcaggggctttatcaagagctgatggaagtctttatcgacatcatgaagcattttgattaactgtttacaggttcgagctcttcagccggttcatccgccgcactgtcctttgcttttttcttcaattttccgtttacgctttcaaagtcattgtcaatattggtgagtgacgtttcgaaaatttccataaaatcatcgccgtagatatggcgtatcatacacatcatttctgccacttcaggaaattttccgaataaatgatacaaaggctgtgaccctttaaaaacagcgttgcgtgtcggatcaaattcctcaagcaagctccagaatacctcggtaccttcctcagtcaattggacatatgtgttccgtttatcattcagccgtttggagaaccttaaatatccccgttcttccagcttttttgaaaagttgaatgcggttgatacgtgcatgaccccgaacttcgcgatttcagaaatggaagctccattcaattgatacgcaatccataaaatatgatgctcattaatattcaggtcatacggtttgagccattgctgccaatccttctcgattgatttccaaagagccttgctaagctgagccattttctgggtgaagaccagagcttctttcacatcatagggcggttccactcgattcattacgtcacctgcttctctttttctttttctctattatgccaataaaataaagattaataaagatgaaaatgtaagaattttttaataaattcacaaaccattgcggcggaagggtttttcggccaaaaaaaatacgggtccaattttggcccgcatttttttcttttgaataggatattagttttgtaaggttttctccagctgtctgattttctcttcgatatcagcaatttctttttgcagatcctgctggtggggcttgatctcttcctgccattttttaattgacgtttggagctcgccgcccacgtctttaataacatccgtgctttcttttgccgctttgatcagctggtcttttaaagcaagcccgtctgactttaagcgtttgattgtttcttcaaaagaatcataattggttttcattttttcacgcagctgctttcctgaggaaggtgcagtaagaagaaccgctgctcctccgatgatgccgcctacgaatagtcctgttaatagagaacgtccgctcgccattacaatcaccccgtctttttcttcaaataggattcattcagcatttttcatttttgttgaaagcctgaacttctatacatagcttgctttattttagcatattttttaagtgaaaaggagggagaaggttgtctgtctttttgattgtgttatcctgcatcacccttgccttcgcttcaggcgctgtttactatatcagacttctcagccaggctgcttcttatccgcccaagaaagtcatccggcagaaagcgcttgtttgttcaaccggaaccgcctttacactatgtcttatctttttcacaaaactcctcgcttaaaacatgctgacatgctgcgggcgctctgttcaaaaaaacctctcccggaagcggaagaggttttgtgtgacaattatttagcagcttccataaagcttgaacgccttaaaatggtttgcacaatcggataaataatgatcattgagattgtattcagcacagcggcaggcagaacaacagccgcgaacaatgcggcgaaaccgcccggtaaaccgacgatcaataaagctgacgatagaaacacaattcccgataagatggtcccgatcactgtcagcacagcggctgcacctgttttccggctctttctgaacaagagaaacagggagaagaacagaaacgctgatacgggtttatcaatgatgttagggatctgtccggctggaaacgcggttgtaagcgcggaaatgattcctgtcacgatcccgatgacgagtacattttgcacccgcgggaacagcagaatgcccatgaacatcatgatcagcatcatatctggtttcatgccgcctaaaaagggcggaataatggaatgaagcgctgcgccgattgcggcaaacagagccataatgactaactcttttgttttcataactatgctctcctctgctaagcttttgccctccaataatatgctcatcatttattgcgaaggctttacagaatgtgttatgcaaacagtataccaaacgaacggtttgcatagccagactttttactcattttcctgctggaatttcttcatgaacgcagctaatttttcacagtcttcgagagagaccgcgttataaatagaagcgcggcagcctcccaccgaacggtgtccaccaaggccgatcatcttcgcatcttttgctttctggacgaatgttttcgttaattcgtcatcccgaagcgtgaaggtgacattcatgcgtgagcggctgtcttttctggcatgtcctttatagaagccgttgctttcatcaatacagctgtagagaacctgcgctttttgttcattgcgctgttcagcagcttccacaccgccgttttccttgagccactccagaacaaggctcagcatataaatcgcaaatgtcggcggagtgttgtagagtgaatccgctttgacatgcgtggaatatttcaagatttttgggacgttcgcattttcattttgcagccagctttttttcatgatgactacagtcacgccggaagggccgaggttcttttgggcgcctccgtagatcacatcaaatttggacacatcgatttttctgcttaaaatatcgctggacatgtcggctacgagcggaattggagaattcggaaactcctgccactgagtgccgaaaattgtattgttggatgtgatatgtaaatatgcgccgtcttttacatccgtaaggtcaacctctggaatataactgtaattgtctgtttcacttgtagcggtgatagacgtgttcccgaacagtttcgtttctgccagtgctttttcagaccaagcgccggtcatcacaaaatgtgcggttttttcaggtgttaaaaagttcatcggaagcattgagaattgaaggcttgccccgccttgaagaaacaagatatcgtaatcttccggaatgcccatcagttcgattaagaggcttttcgctttttggtgcaccgcttcatactctttgctgcggtgggaaagctccataacagacatgccggattcgttaaaatcaataaattctttctgtgctttttgcagaacttccagtggcagcgctgcaggacctgcgttaaaattcgttgtacgttccattatgatctctccctgttttccacgttaatgtataaaataatacaattatcctatcacaaaaattcagttttttgataaaaaattagaattatcaaaagaaattgacggatgtttgcgaaatgttcacaaaataaaataacctcatcttatgatgaggccaggcgttttgcgatagaggaagagatgttctgcagatcctccggtttataatcatcagcatgcgttttccaaaccgctccgaatccatctccttttccgtagcgagggataatatgcatatggtagtggaacacagattgtccagctttttcgccgttattgttcagcgtatttaagccgatcggttcaaattcatcccggatagcgcgggcgatttttggaacagcatggaaatattgttttgctaattcatctgtaaattcatatacattctcaatatgtgttttcggaatgacaagcgtatggccttttgtcacttggctgatatcaagaaaggcaagtacatgttcatcttcatacaccttcgcggatggaatgtcgccggcgataattttacaaaagatacaattctctgcacaatgcatgagggttcctccttatgaaattgtttagtatgtatacactcatcgtaccacagaaatgcagaaaatagaaaacaggatgaacggcgagcgttcaccctgaatgcagaggaagagcttatatgaagaaaatgtgttatgcctttggtaagcacctcatttgtcaataaaatgaagacttgtttaatgcctaacgattcctgcgataaacacctcatttgacaatttgcttcatacatgaagaattcatcaattcagtgaagagaaatggtttgagcattggacatgtttattttctatccaactgtttctaagacgtctttgacaaacacctcatttttcagttgatatgcttttcctctacaactattatgatgtccagaacctgtctctttatgacagcaaattcatcatttgttaaaagggaattgtttcaaatcaggccttgtttttggtactatgaagaaaaacactataaggggagaaactatgtctctgctatcggtaaaagacttgaccggcggatatacaaggaatccggttttaaaaagcgtatcattcacccttgaaccgaatcaaattgtcggattaatcgggctgaatggtgctggtaaaagtacaacaatcagacacatcatcgggctgatggacccgcataaaggttcaatcgcattaaacggtaaaacgtttgctgaggatccggaaggctaccgttcacaatttacctatatacctgaaacacctgttttatacgaagaattgacgctgatggagcatcttgaactaacagccatggcatatggactgtcaaaagaaacgatggagaaaaggctgcctccgcttttaaaggaattccgaatggaaaagaggctgaagtggttcccggcccatttttctaaaggaatgaagcagaaggttatgattatgtgcgcatttttggcagagcctgcgctctacattattgatgagccttttctagggcttgatccgcttgccattaacgcgctgcttgaacggatgaatgaagcgaaaaaaggcggggcgagcgtgctgatgtcaacacacattttggcaacggcagaacgctattgcgattcgtttattattttacataacggcgaggtgcgggcgcgcggcacgctgtcagagctcagagagcagtttggaatgaaggacgcggcgctggacgatttgtatcttgagcttacaaaggaagacgctggccatgaataatatgcttgatatttggcagtcgcggctgcaggagcatatcaaagaaacaagaacatacatgaaatatatgctcaatgatcacctcgtcattgttttgattttttttctagcgggcgctgcaagctggtacagcaaatggatacgggacattcccgctcactttccatccttttgggtgatggccgtgctgttttcgctcgtgttgacaagctcttatgtgcgaacgcttttgaaggaggctgaccttgttttcttattgcctcttgaagcaaaaatggagccttacttgaagcaggcgtttgtctacagctatgtgtctcagctgtttccgcttattgcgctgagcatcgttgcgatgccgctttatttcgcagtcacaccgggggcttcgctcgtatcgtatgccgcggtctttgtccaactgttgctgctgaaagcgtggaatcaggtaatggaatggcgcacgactttccaaaacgaccgcagcatgaaacggatggacgtcatcattcgatttgcggcgaatacactcgttctttattttgttttccaatctgtttatatgtatgcgcttctcgtctatgtcattatggctgttctttatctgtatatgtcttccgcagcaaaacggaaaacatttaaatgggaaagccatattgagtccgaattgagacgaaagcagcgtttctatcggattgccaacctgtttactgatgtgccgcatttgcgaaagcaagccaaacgaagagcttatctcgactttttgctgcggcttgtgccgtttgaacagcgcaaaacatttgcctatatgttcacccgcgcctttttgcgttcgagtgattatttgggcattcttgtcagattaacgatcgttttcgcgctgatcattatgtatgtctcagctagcccgctgattgcagcggttttgactgtgtttgccattttcattacgggcattcagcttctgccgctcttcggccactttgaccatctggcgcttcaagagctgtaccctgtgaaaaaagaaacaaagctgaaaagctatttctctctattaaaaactgcacttagtattcaagcgctgctgatgtctgttgcgtctgcctatgcagccggcttgaccggttttctgtacgcgctgatcggttctgccgttctgatttttgttgttttgccttcttatatgacaaccaggctgaaaaagcacggaaagctgtgaactgaaaagaggtaatcaaatgacagataatcagctgctgatgcaggaagctttgcaatggaaaatgcattttttgcgaaaggattccatgtttgaacgcttttcgaagcgtgtccagacgaaggtgaatgaacggattcctgaaaaaatccatacggtcgtcaccgagagtgtgaaaaaaatggtagaagcgacaatgaccggctccaatatcattacttataaaaaggatacaagtgcactgtcgctcagtgaaaaaaacgaattggcgaaaaaaacgattatttcttatcagaaggtggcggctgctgagggagtcggaaccggagcgggcggcatttttttaggcattgctgattttccgttgctgctttcaattaagatgaagtgtttatttaccttgtcttccatttacggctttgatgtcaaggatgcacaagaaagaatgtttttgctgctcgtgtttcagcttgcgttttcgagtgatgatggccgtaaatcgcttttttctgtcatcgaaaattgggagacggagaaaaagagcatcgactggagagtgttccagcaggaatatcgcgattatatcgacgtcgtgaagctttttcagcttttgccgggcgtaggagcggcagtcggcggaattgccaattataagctgcttgctcagcttggagaaacggcaagacatgtttttcatctgaggatattaaaggaaacagccggagaataaacactccggctgttttttatagctgatgataggtgattgcagcgccggcaaggaccttggccgctgtcagcatggctttttcgttgatatcaaatttcggatggtggtgggaataaactcgatctggctgttcgggagctgcacctgtaaagaaaaaagtgcctttcacgttttgtaagtaataagcaaaatcctcgccgcccatttgcggttcaccgtcaatgacctgctgaacgccctcggtattctttgcggtgctcaccaagtggatcgtttcggcaggatggttcacaaccgccggataaccctgttcataggtgtactcataggacgcgccgtgcatgctgcatattccttttacaaccgcttcaatttctttctccagaatgtcccggacattttcatcaaaagaacgcgctgtgccgatgagtactgcttggtctgcgatgacattaaacggattgtcggcgatgaaggagcctgtcgagatgacggcggattgaatcggattgactttgcggctgacaatgtgctgcaaagaggaaacgatttgcgaaccgatcaggacggcgtctttagtatcatgcggatgagcgccgtggccgccctttccgaagactttaatcgtaaatcggtctgccgccgacattacggcgccggggcggcagagaatagttccgagcggctcagttgcccaaagatgagtgccgaatatcacatccgtgttttcgagacagccgtcatcgatcattggctttgcgcctcccggataatattcttctgcatgctggtggatcatcacaaatgttcccttcagttcatgtctgttttggtgaaggaccttggccactgcgagaagagctgcggtgtggccgtcgtggccgcatgcatgcatgacaccaggcactttggaggcgtaagggacatctttttcatcttgaatggggagagcgtcaaagtcggccctcaaagcgactgtagggccgggttcgcttccttctatatatgctaaaacccctctgccgccaacgtttgtgcggattgggactcctaacgattcataataggaagcaataaatgcggcggttttttcttcttgaaatgaaagctcaggatacatatgaaaatggcgcctgatctcaaccatttcttcaaaacagccgtcgagctgtttgtttatctctttctgcagtgtggatatggacaaagccgcttcccccttttctatgttttccatgattgtatagaaaaagtctgaatatttcaactcgtgctgttttaaagcatcatcacagctgcgagggttgtcaccaaaaggccaatcgcgacgggaatgaagttttttctggcaagctcaaaaggatcaactttgcaaatggccgccgcgggaatcaacgcccatgggaccagtgttcctccgcccacccagatggcagagatttgtccgagcgcggtcagaacggcgggatcggcatggagagcggacgaaaagagctttgcgatggagccggcgagagaaatgccagaaaatcctgagccgtcaaggcctgttatggctccagcggcagttaatgcagcggcggcaagttcctttgacataggcatcatttgggataaagcaatgccaagatcgttgacaatgccgtgggaacctttagggagtgaagtgcccagtatgctctcatagcctgagtcgccaagataaaagaaagcggcaatcgggatgacggggccgaaaaccttaaaaccgaacttaaatccgtcaataaaatagccggtgattttttcaagccctttatgcttatacacgaaaaaatgaacggtaaagaggatacaaattgcagacccgccaattaacgcggttgcatcatttccttgtaggttaaacaagagcatgcaggcgatatctgcaagaaaggcaagcggaatcaaaaaagccagtatggaccgcaggcgttttggcaagtacagcgagttgtcttgttcgccggaaagaacgggggaaaaagaagcgggatgctcctgttttttgcgttcgcgctgaatcatgacaaaggcagcggttgttgttgtcgcacccataatcagcacaagcggaatgctggccgagacgacatcaccgactggaatgcctgctgcatctgcagtcagctttggcgccgcctgaatgacaaagtctcctgacagggcaaaaccgtgtccgaataagttcatggccatggccgcggcaagaggcgtcaaaccggcacgtgcggctgcggggagcaggacggcgccgatcaaagcgacacccggagaaggccagaagaagagagaaatggcgaacatcaggcccccaatcagccaataggcagtcacaggccctctcacaaggcttgcaaagggagaaatcatcgcttcatttatccctgtttttgttaacaaatcactcattgaaacgataaagcaaatgatgaaaatcgtgggcagcagttcgccggccgcatagataaagctgtggaataaactgctgacagaagctgaaagtgaatggctggcccatagcgatatgataaaaatgccgaatagagaaataaatgtcgtgtcttttctcagcagcataaataggataattgcaccgataaaaaacacatacagaacatggacagacaaaatcccgacttccatcatcgatcactccttccgcttacagattattcataggcgggcggaaggtgccgggacagaggggagggttatgatggaagatgaacattgatctgtttcagctgccaatcagatgatgccttaatactctattcgctttttgcagatgttttgggaagcattcaggagaaaaaatgacgcacccttcagcaagccagttttttctataggcgatgctgctttccgatggctctaaatatgaatcatcctcgtgctgcatttcgtaatcatcaaatccgaactgaaaaccgcagcacgggcagatttcatgagaatgattgccttcatgatcatatggcggttcagccaatcccttaaacccgcagactgggcaagtatgcttcattttgctttcctcccaataaaataagctgccggacatgccggcagctattcgacagcgaaatatgtggtgacataggaaggccgggagaagatcgacgttgtgtcaattccggcagatgtatcgcgttttttgtgggcttctttgtaagaaccggactgctgccagtcttgaaaggcgctttccgtttcccataaggtcagaatgacataggtgtcactgtcaagcggacggagcactcgaattgcttcaaagccaggctcgttttcgacttttcccgctctgtttttaaatctgttttcaaacagcggacgcccttcctgagtaacggcaatattgttcaatactgcaaaaccgggatgtttgatctctccgacttggtcaatgacttcataagcgtgtggtgcctggaaaacggtatctccgtttgtttcatgaattaaaatggcgttttcctgcccctgcatcaaaaggatattttctgagggatgcttctgtacgatcgtttttaaaaaatcggctgtcccatatgtaatataaaccttcatatcagccacctcctgcttgctagtatatcaaaacaatggtataagtttctattggcgagtgcttcgaacataattccaaacaatttttcccatactacctttagaaaggcgaggtgagttcatgtttaagataaagaaaaagaaactttttatacctatcattattttagtgttaactgcttttctcgctttaataggatatatttcaattatttttctcggccattatgtcatagatgaaaaaaagcttattcttcatgcttcttcaaaaattgttgatcaaaacggagatgaggttgcaagcctgtatacagaaaatcgcgagccggtctcgatcaatgagattcctaagcaggtcagagaagcgtttatcgctgttgaggataaaaggttctatgagcatcacggcattgatgcaaaatctgtcggaagagcagtgtatcgcgatatattagcaggcggaaaggtggaaggcggaagcacgatcacccagcagcttgccaaaaatatttttctgacacatgacaaaacgtttctaagaaaaacaaaagaagtgatcattgcgatcaatcttgaacgggattacagcaaggacaagctgcttgaaatgtatttaaatcagctttacttcggacatggggtttacggcatacaagcggcgtcccactattattttaataaagaagtaaaagatttgactgtatctgaaggcgctgttttggccgctattccgaaggcgccttctacgtactctccaattttgcaccctgataaaaataaggagcggcgtgatacaattctaggtatgatgaatgaccaaggctatatcagtgcgaaagaggctgtcaccgcacagggccgaacgcttggactgcacgtgaagaaacagtcggaaacaccttggtttgacagctacattgaccttgtgatcaaagaggcggaagacaagtattccatttccggagagcagcttcttcaaggcggatacacgatcaaggtgccgctcgattcgaagctgcagaagacggcttaccaggtgatgaaagagggaagctattatcccggaacagatcagaatgccgagggaagcgcggtctttattaataacaagacaggcggtgtagaagcggccatcggcggaagggattacacatccaaaggatataaccgtgtcacagctgtccgccagccgggttccacatttaagccgcttgctgtatacggaccggcgatgcaggaaaagaaatttaagccatattctctattgaaggatgagttgcagtcctacggagattatacgccgaaaaactacgacagccggtatgagggcgaagtcactatgtctgacgccattacgtacagcaaaaacgcgccggctgtctggacgctgaatgagatcggcgtcgaaacaggaaaatcttatttgaaagcaaacggcattgatatccctgatgaaggacttgctctcgctctaggcggcttggaaaaaggcgtttcgccgctccagcttgccggcgcgtttcatacatttgccgcgaatggaacgtatacggaacccttctttatctcgagcataatagatgaagacggagaaacaatagccgatcataaagaggaaggaaagcgggttttcagcaagcagacgtcttggaatatgacgagaatgctgcagcaggtagtcaaaaagggaacggccacgtccggcacctatcacggcgacctggcgggaaaaacaggttctacatcttatacaggcgtctccggcgcgacaaaggacgcctggtttgcaggctatacgccgaaaataaccggggcagtctggatgggctatgacaaaacggatcaaaaccattatttgaaagccgggagctcatacccgacgcggctgtttaaggatattttgacacaggcaggagaaaccggtcatgtgttcacaaagcctaaaaacattaaagacctggaaagcccgattgagttgaagccggtcaaaacactcacagccgattacacatttaaagcagcgggactctttactattgaattaaagtgggacgctcaagaggatgatcgggccgtatacagaatttatgtaaacaaggacggcgaggagacgcttcttgattcggttgaagggaagggaagctatgaaattccttatgccaacttattttcgggcgcgtcttataaaattgtgccttataatacacagacaaaaagagaaggggaaggaaccgattacgttcagccaaaattgttttcctcttaatggaattcggcgattttttgaactttgagctacatttctataccatttgcctaaaacaaggtatagtgtaataagtcaagaaatacgaacgtatggttgccgtatgaaaggtggaaatcagatgagtaaacgagaaacgtttaacgagacgtttttaaaagctgcgcggggagaaaaagcggatcacacgcctgtgtggtatatgaggcaagcagggcgctcacagccggaataccgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtgaatgttgaaatcaaaaacgggatcggtcctgtgattgatcagccaatccggtctctgacggacattgaaaaactcggccaaattgatccggaacaggacgtgccgtacgtgcttgagacaattaaactgcttgtcaatgagcagctgaacgtcccgctcatcggtttctcaggtgcgccttttacgcttgcaagctatatgatcgaaggcggcccatcgaaaaactacaataaaacaaaagccttcatgtacagcatgccggatgcatggaatctgctgatgtccaagcttgccgacatgatcattgtgtatgtgaaagcgcagattaaagcaggcgcaaaagcgattcaaatctttgattcgtgggtcggcgcattgaatcaggcagattacagaacatacatcaaacccgtaatgaaccggattttttcagagctcgcaaaggagaatgtgccgctgatcatgtttggcgttggcgcaagccatcttgcaggtgattggcatgaccttcctctcgatgttgtcgggcttgactggagactcggcattgctgaagccagatcaaaaggaattactaaaacagtgcagggcaacctggacccgtccattttgcttgcgccatgggaagtcattgagcagaaaacgaaggaaatacttgatcagggtatggagtcagacggcttcattttcaatcttggccatggggtatttcctgatgtcagtcccgaggttttgaaaaaactgacagcatttgtccatgaatattcacaaaacaaaaaaatgggtcaatattcctaagcatatcttttggtatcttaatgatatcctgtcaaaatgtttgtatcagatcattaaagagggtgtaaacagtgagtagaaagaaaatggggcttctcgtgatggcgtacggcacgccttataaggaagaagatattgaacgttattatacacatatcagaagaggcagaaagcctgaacctgaaatgcttcaagatttgaaagacagatacgaagcgattggcggcatttcaccgcttgccaaaatcacagaagagcaggcgcataatctggaacagcacttgaatgaaattcaggatgagattacgtttaaagcgtatatcggactgaagcatatcgagccgtttattgaagacgccgtagcagagatgcataaggatggcattacagaagcagtcagcatcgtgctggcgccgcatttctccacgttcagcgttcagtcctacaacaaacgcgccaaagaagaggctgaaaaactcggcggcttaacgattacgtcagttgaaagctggtacgatgaacctaagttcgtgaaatattgggttgaccgagtgaaggaaacatatgcgtcaatgcctgaggatgaaagagaaaacgcgatgctcatcgtatccgcacacagcctgccggaaaaaatcaaagaatttggagacccgtatccggaccagctgcatgactcggcgaaattgattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttggatttgtcgcggatcacttagaagtgctttatgataatgattatgaatgcaaagtggtgactgacgatatcggcgcaagctattaccggccggaaatgccaaatgccaagcctgaatttattgatgctttggcaacagtcgtattaaaaaaattaggacgttaaagaaggcgatgaacatgagtgacggcaaaaaacatgtagtcatcatcggcggcggcattaccggtttagccgccgccttctatatggaaaaagaaatcaaagaaaagaatctgccgcttgaactgacgcttgttgaggcaagtccgagagtcggcggaaaaatccagactgtcaagaaggacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcaccctgcatccaatgccgaagggcgctgtaatggggataccgacaaaaattgcgccgtttgtttctacgggtctgttttctttgtctgggaaggcgagagctgctatggatttcatcctgcctgcaagcaaaacaaaggatgatcagtcattgggagaattcttccgcagacgtgtcggagatgaagtggtcgagaacttaatcgagccgcttctatcagggatctatgcaggcgacattgacaagctcagcctgatgtcgacattcccgcaattttaccagacagaacaaaagcatagaagcctgattctcggcatgaaaaaaacaaggcctcaaggctcaggccagcagctgacggcaaagaagcaaggccagttccagactttgtcaaccggattgcaaacccttgttgaagagatcgaaaagcagttaaagctgacgaaggtgtataaaggcacaaaagtgaccaagctcagccgtggcggctctggttactcgctcgaattggataacggcgtcacacttgatgctgattcagtaattgtgactgctccgcataaagcggctgcgggaatgctttctgagcttcctgccatttctcatttgaaaaatatgcactccacatcggtggcaaatgtcgctttaggtttccctgaaggctccgtcgagatggagcatgagggcacgggttttgttatttcaagaaacagtgactttgcgatcactgcctgtacgtggacgaataaaaaatggccgcacgcagctccggaaggcaaaacgctgcttcgggcatatgtcggaaaagctggagacgaatccattgtcgatctatcagataatgacattatcaacattgtgttagaagacttaaagaaagtcatgaacataaacggcgagccggaaatgacatgtgtcacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaaaacctccgctttatcgcggaggtttttttgatgtgcaatggcaatattgtgtaaaaaaatgattgaattgaacagcaggttatgatacatttgcatatgtacttaatgactaaaatgttcaaacggtcagtttcgaggtgaatacaatgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaagcaaaaagcggatgaagcgatggagccgaaccttccgttccatgaaaatgtgcacagagcgctgtttgccattctggagttcaggaaaacacatcagctgacgattaaaattttccaagagaatgccgagattggtacaatggcagttcaggaagtgatccagaaaatggagcgagccatactgtcttatatcaaaagtaagattgaagacgggatcaaaagcggcgcaatcaagccgtgcgaccctgaactgacagcctttgtgatgctgaagctttatatcgcgctcatttttgactgggaaaaacaacaccccccgcttgataaagagacaattgcgggactgcttgaattgtatgttgtcaaaggattgtcagcgaactagataatcctttctctttgcaagaaaatgaccatttttcatgatgagtcagttttagaatggaggcatcaggatgaacacaatacgaagtcagtggaaagacatcgtaacaagtaaaaaattattgattcccatcatcgccattttgtttgtcccgcttatttacagcggcgtattcttaaaggcttattgggacccgtacggcacagttgaccagctgcctgtcgttgtcgtcaaccaagacaagggagcaacgtatgaaggagaaaaacttcaaatcggtgatgatctggtcaaagaattaaaggataataacaactttgattggcatttttccaatgatctcgaccaatcgttaaaggacttattgaatcaaaaatattatttagttgtcgagattcctgaggatttttctaagaatgccagcactgtattagacaaaaatccgaaaaaattggatctgaaataccacacaaatgcaggttctaactatgtaggggcaacgatcggcgaaaaagcgattgataaactgaaagcctctgtttcaaaagaagtgaccgagcaatatacgaaagttatctttgataactttaaagatatcgcaaaaggtttgagcgacgcgagcagcggcgcgaaaaaaattgatgacggcacaaaggatgcgaaaaacggaagcgcacagctgaaagaaaatctggcgaagctgaaggaaagcaccgctaccatcagtgacaaaacagcgcagcttgcagatggagcggctcaggtgacgagcggcatccaatcacttgatagctcgctcggtaaattccaggacagcagcaaccagatttatgataaatctagtcagcttgcagcaggatcaggcgaactgacaagcaagatgaatgaacttcttgctggacttcaaaatgtgcagaagggtgcgcctaatcttactaacgggctggatcagctcaacagtaaagcccaagaaggttctgagaaagcagcaaaagcggaaaagctcattaatgcgctcgatttaacgaagcttgaaactgctgtaaacaatctggaaaaatcagaaactgcgatgaaggaatttaaaaaacagctgtctgactttgaaaacagcttaaaaaaccgtgatcaggcattcaaaaatctcatcaattcgagtgatttcttaacagcggagcaaaaaagccagttgatcagctctgttggaaagcagctgccgaaagttgatgcgcctgattttgatgaaattttaagtgggcttccttcagctgatcagctgcctgacatcgcaacgataaaaagctctcttgaagacgtgaaagcgcaggtggcgcaggtgaaagccatgccggaagctacatctaagctttataacggcgcaaaaacaatccaagatgcaattgacagattaactgagggagctgataagatatacaatggttcacagaagctgacagatggccaaactaaactgacagccggcatcggtgaatataataagcagttcgcaaaggcaaaagcgggctcagagcaattggtgacaggaagcagccaagtatccggcggattgtttaagctgttagacgggtctaaacaggtccaaagcggatcatcaaaacttgcagacggatctgcatcacttgatacaggtttaggcaagctattggacggcacaggagagctgtctagtaagctgaaggatgcggctgaccaaacaggagatatcgatgctgatgatcaaacatacggcatgtttgcggatccggttaaaaccaaagatgatgccattcattccgttcctaactatggaacagggctgacaccttatatcctgtcaatgggcttgtatgtcggcggcatcatgctgacggttgtcttcccgctgaaggaagcgtcaggacgtccgagaaacggttttgagtggttcttcagcaaattcaatgtcatgatgcttgtaggaatcattcaatcattgattgtggcgacggttcttctattgggaattggtctcgaggtagagagcacgtggagattttacgtgtttacgatcattacgagtctcgctttcctggcgatgattcaatttttggctaccacgatgggcaaccctggacgttttatcgcagtcattattttagtgctgcagctgggagcgagcggaggaaccttcccgcttgaattgctcccgaatttctatcaggtcatccatggcgcgttgccgatgacctacagcattaacggattcagagctgtcatttcaaacggtgactttggctacatgtggcagatggccggcgtcttaatcggcatcgccctcgtcatgattgcactaagcattacttactttacaatgttaagccggaaggaagaatcatcagaagaacagccggcttcataaagaaaaagaacttgtttccttggaaacaagttcttttttttgttacattccccatttaataagcaatcctgtataggttaatccgccgccaaacccgaaaagcaaaacaatttgatcttttttcagcttcccggctttcactgcgagatcgagcgccaaaacaattgaaaccgaagacgtgtttccgtaatgctcaacactagtgagcgttttttcaatcgggaacggtgttttttcacaaattgactcgatcatgcgcaagttggcgctgtgaggaacaaaccaatcgagatcatcagagctgagtcctgctttatgtaaaagccgttcaaattcgccagggacggttcttgcggcccatttatatacctcgcgtccgttttgcaccatttttccagaaccgacaagctgcacaccgtttatttcatttcgcagtccggcacgatacaaaatatctccgccgttcccgcttgttccttgtacagacgcaagaaatcccggcgtctcttcatctcgttccactaacagcgcaccagcggcatcgccgaacagaacgcatgtcgttcgatcggtataatccgttacctttgataacgtctctccggcgatcacgagaattttttgatgaaggccagatgtgatcaatccatttgccaaatggaggccgtaagtcagcccggcgcatgtcgcattaatatccagcgcgccggtgctttcccagccgaaatattcctgtacgcggcatgccgtacttggaaaggcgtaatcggatgtggttgtggcaacgaggatcatatcgacatcatcaagtgttcctttataacggctcttgagattcttcaccgcttctatgcataaatcagaggtaaattgatgttcatctgcaatccggcgttctctcattcctgtgcgctgaacgatccattcatcagaggtatcaacgatcttttctaaatctgcattggttaaacgtctgctcggcgcataggtgccgatagctgtaatttttgcttttgacatatgaatcactccttatggtcagattataacactagatattagtatctggtactaaaaagaaggtttttttacaaaaaaagagaagtgtagaatagggaatctatgaaaaagaaaaaggaggctgaaaaatggtcagtcaagaagcagtagtctttttggcattatccggggctattgcgtttctgttgccaatcgggctgattgtatggtttaagcgaaagtatggcgcctcgcttaaagtgttttttattggcgctctcacgttttttgtcttcgctcagctgctggaaggcggcgttcatgtttatgtactgcaagtgaatgaaatgacgaaagaagcgatgcaacatccattatggtatggcatttacggctgcttgatggccggaatttttgaggagtgcggaaggtatatgatgatgcgattttttatgaagcgccatcatacttgggcggatggtctggctttcggggcaggccatggcgggcttgaagccatcctgattacaggcttgtcctctatctcacttattgtatacgcatttgcaatcaatagcgggacgtttgaacagcttttggtcaatggcgacgtcaaacaggcgcttttgccgatacaggagcagctgctgcatactccttcgtatgaatggatgctgggcggaatagaaagagtcagtgccattgccgtccaaattgggctgtctctgcttgttttgtacgcggttaaaagccgccggccgctgtttttgttgtattctattcttttacatgcactgtttaatgtaccggcggttttatatcagagaggaatcatagagcatgctgcagctgttgaaatcattattgctcttatagcggctttatcagtttattggattgtaaaagcaaaaagggtgtttcaataaaaggtccaagcagcagcaatgcccgcttggaaaaatgtgaatggaaatattcattaagcatgggtcatcagaatatttctgattcagtctttacaatgacagcaagaatgtctgtgttttttacaagagaaacaatggtgtttctttttcttcttctcgcaagggtcatggcattctttctttttcttgcaatggtcgtggaaatctttatcgaaccactcgtcaaagaaccaaaaatcatcgaaccaatcgtgacaacgacatttctgttcatgtgaatgacgacagcacatagaaatccctcctcttcccatgctctctacagcatatgagagattgataggaaaagattggacgggtccctcgggaaaagagtatattttaagtagaaaataaaaggaggaatgccctatgacgtctgtacgtaaaacgatggagctcattaaagaactggtatcgatcccaagcccgaccggaaatacatatgaggtgatcaattatattgaaagccttttaaaagaatggaaggtagaaacggttcggaaccacaagggcggcttaattgcaacgcttccaggacgcgacacatcccggcatcgcatgctgactgcgcacgttgacaccctcggcgctatggtaaaggaaattaaagcggacggccggctgaaaatcgatttaatcggcgggttccgctacaactcgattgagggggagtattgccaaattgaaaccgcctcaggaaaaacgtacacaggcacaatcttaatgcatcaaacgtctgtgcacgtatacaaagacgcgggaaaggctgagcggaatcaagagaatatggagatccgcctagatgaacctgttcactgccggaaagatacggaggagcttggcattggcgtcggagactttgtgtcgtttgatccacgtgtcgagatcacatcaagcggatttattaaatcgcgccatttggatgacaaagcaagcgtcgccttattgctccgcttaattcatgaaattcaaacagaagacattgagctgccgtatacaacccattttcttatttccaataatgaagaaatcggttacggcgggaattcgaatattcctcctgaaacagttgaatatttggcggttgatatgggcgctatcggtgacgggcaggcgacagatgaatattcagtatcaatctgtgtgaaggatgcgagcgggccgtatcattatcagctcagaaagcatttagttcaattagccgagaagcatcatattgactataagcttgatatatatccgtactacgggtctgatgcgtcagcagcgatcaaatccgggcatgatattgtgcatggcctcatagggccgggaattgacgcttcccatgcatttgaacgcacccataaatcatctcttcgccataccgctaagcttctgtattactatgtacagtcaccaatggtataagggggaggaccaatgaagatttataagctgaaaagcacattcggctgggaaggtgatgatgggttgggagaacagctgattcagcagatccttgccggagaaaaaaccgccacgtgcgcgccgaaatcattgtattcaaaagatgaattgagggacgtttatcaaacagcgggtcagcttgttaccgtttatgataaacatgacaatccaagatgcaatataaaagtgacagatgtctttgaaaccacctttggtgcgcctgatatgaggttagtcaaaggagagggcaatggagatcgaattgaggagtttcaagaggatcatcggatggcatgggcggaactgatcaaaagcggtgaactggagctgaatgaggatactgttttgattacagaactgtttgtgcttgttaaagattaaaaaagcctgcggggcaagaaccccgcaggcttttcattaaccagaaatggttgcgttttgttctgttttcgattgggacataacagtttctgctttcgcaggattaaacatgccttcccatttagacatcacaacggcagcaagcgcgttaccagtcaggttgacaactgtacgtgccatatccatgatgcggtctacgccggcaataaaggcaagtccttcagccggaacgccgatggtgccaagcgttgcaagcaagacaacaaaagaagtaccaggtacggcagccatccctttggatgtcaccattaagacgagcacaagcgtaatttggtgccaaatcgtcaaatcaatgccatatacctgtgctaaaaagagtgcggcaatagattgatagagaacggaaccgtctaagttaaatgtgtaaccgatcggaatgacaaatgaaacaatgccttttggacatccgattttctccattttttccatgatgcgcggaagaaccgtttcagagctggacgtactgaacgccagtaagatttcgtccttcatgtaagcaaggaacttgaagatgctgatgccagcaatttttgcgacaatcccgaaaataacaattaagaagaaagcaagcgcgacataaaccaatccgacgagctttccgagagagataagagaaccgagtccgaatttagacacagtcactccgataagagcgaaaacgccgaatggcgccactttcatcacaaggtttacaacgtggaacatggcatgggatacaccttcaaaaaaggctaatacaggcttgcctctttcaccgatcgcggaaatacccaatgcaaatagtactgtaaagcagatgatggctagaagatccccttcgaccaatgactggaagaagtttgtcggcacaatatggaggaacgtttccgccactgatttattactttgttctttttcagtttcaacatattgactgatgtccgatttttgagcttcgtgtatattaactcctgtacccggatggaagatgtttgcaagggctagtccgagaataatggcaaaagtcgtgatgatctcgaagtacagaatcgttctgaagcctaatttaccgacttgctttccatttcctgcaccggctacaccgatgattaagctggagacaacaataggaatcactatcattttgattaagcgtaaaaagagatccccgattggctgcaggtaagtaggcaatgctgggttgccataccaaatgacgccaacaatgacacctagaataagtccaacgaatatttgtgtggctaatccaaacttaattcttttcatagactacctcccaaaaaaacaaagtatcaacatatatcatgaatagacatatatttaatctcactattagatcaaattataatagataagaaatcaattcgtctatagtaaattatatttcgaaaataaagaatattcaatgacattatgataatcaccagaattatctaaaaacaggtgagctttgacctaacctgactattatttcaaaattaagagatatgtgaaaaaataagaaaatcccacgcgtaaggcgcgggattttcgctcattacaaatcgtttacttttatacagtcattgcagatattaccataacactcatgctgctcttctatcttttttccgcattccgcacactttttcgaaggcaggtttctaaaaaattctgtgattttccccagcataaccaatccctctttcccctttgtagtgatttcattgtaatataacagattacaaaaatcaataactgttttgatacaatgtttaaaacatgcttttttcaagaaaaatgggtatattgaaggaggaccaatttttttgaaaagataggaggacattatgaaagttacagttatcggatgctatggcggttttccggccgcaaatgaagcgacgtcaggctatttgtttcagtcaggtgattactctctgcttgttgattgcggcagtgccgttttgtctaagctgttcggatatgtgccggcggaaaagctggatgcggtcgttctgtctcattatcaccatgaccatatcgctgatatcgggccgctgcaatttgccaagcaagtcggttcgtttctcggcaaaggagagcatacgcttccgatttacggacatgatgctgatatagaacagtttcaaaagcttacatataaaacacatacaaaagggatcgcctatcagccggatcagccgctgactgccggtccgtttacgatcacctttttaaaaacgattcacccggtgacgtgctatgccatgcggattactgacggcagccacactgtcgtttatactgctgattccagctatcaggattcatttataccgttttcgaaagatgctgatttattgatctcagaatgcaatttttatgccgatcaagacggaacaagtgcaggccatatgaacagcctggaagccgggcgcattgcaaaagaagcgggagcgggagaactgctgctgacccatttgccgcattttggcgtgcatgacaaccttcgcaaagaagcgaaaaccgtttttaacggagaagtgaatattgcgaaatcaggttttgtgtgggaaggataaaggaggagcaccatgttatttatagacaatcaaaatatcaatgatccgcggatcaatcttgctatcgaggagtactgtgtaaagcatttagaccctgaacagcaatatttgctcttttatgtgaatcaaccgtctattatcattgggaaaaaccaaaatacaatagaagaaatcaatacaaaatatgttgaggaaaacgggattatcgtcgtccgccgtttatcaggcgggggcgctgtgtaccatgatctggggaacttgaacttcagctttattaccaaggatgacggggacagctttcataactttaaaaaattcactgagccggtgattcaggcgttacatcagcttggggttgaagctgaattaaccggccggaacgacattgtagtggatggccggaaaatatccggaaacgctcagtttgcaacgaaaggccgtattttcagccacggcaccctcatgtttgattcagccattgatcatgttgtatcagcattaaaggtgaaaaaggataaaattgaatcaaaaggcatcaaatcgatcagaagccgagtagcaaacatcagtgagtttctcgatgataaaatgaccaccgaagaattccgcagccatttgcttcgccatatttttaacacaaacgacattggaaacgtgccggagtataagctgacggaaaaagattgggagaccattcatcaaatttcgaaagagcgctatcagaattgggattggaactacggccgctcgccgaaatttaaccttaatcattcgaaacgttatccggttggatcgatcgatttgcgcctagaggtcaagaaaggcaaaatcgaggactgcaaaatcttcggagatttcttcggtgtcggtgatgtatctgaaattgaaaacctgctggccggaaaacaatacgaacgcagcgtcatcgctgatgtgctcgaaggtgtgaatctcaagcattactttgggaacattacgaaagaggatttccttgatctgatttattaaggcaaaacacatcgtttgaaagagcggttgtgtttttgaaataatggaggcaggagggattcacatgaaagtgtttttaatcggagcgaacggacaaatcgggcaaagacttgtctctttattccaagataatcctgatcattccatcagagcgatggtcagaaaagaagaacagaaagcgtctcttgaagctgccggtgcagaagctgtgcttgcgaatctggagggcagcccggaagaaatcgccgctgcggcaaaaggttgtgacgcgatcattttcacagccggttccggcggcagcacaggctatgataaaacgctgctggtggatctcgatggagcggcaaaagccattgaagctgcggacattgccggaatcaaacggtttattatggtcagcgccctgcaagcccatcaccgtgaaaattggaatgaggcactcaagccttattatgtggccaagcattatgctgataaaattcttgaagcgagcggtttaacctatacgattatccgtccgggaggccttcgcaatgagcctggaacgggaactgtttcagcagcgaaggatctggagcggggatttatttcccgtgaggacgttgcaaaaacggtcattgcctctttagatgagaagaatacggaaaatcgggcctttgatctgacagaaggagatacgccgattgccgaagcattgaagaaactatgacagtattgacactcagggctttttgctcttgagtgtttttttctgtttctctataatggaggagaaagcttggcttcaataatgaatgactattcattcactttaaggggtgggagaatgaatcttgtttcaaaattggaagaaacagcatctgagaagcccgacagcatcgcatgcaggtttaaggatcacatgatgacgtatcaagagctgaatgaacatattcagcgatttgcggacggccttcaggaagccggtatggagaaaggggaccatctagctttgctgcttggcaattcgcctgattttatcatcgcgttttttggcgctttaaaagctgggatcgtggttgttcccatcaatccgttgtacacgccgacagaaattggttatatgctgacaaatggtgatgtaaaggcgatcgttggcgttagccagcttttgccgctttatgagagcatgcatgaatcgctgccaaaggttgagctcgtcattttatgccagacgggggaggccgagccggaagccgcggacccagaggtcaggatgaaaatgacaacgtttgcaaaaatattgcggccgacatctgctgctaaacaaaaccaagaacttgtccctgatgataccgcggttattctatatacgtcaggaacgactggaaaaccgaaaggcgcgatgctgactcatcagaatttgtacagcaatgccaacgatgtcgcaggctatttgggaatggatgagagggacaatgtggtctgcgctcttcccatgtttcacgtgttttgtttaaccgtctgcatgaatgcaccgctgatgagcggcgcaactgtcttgattgagcctcaattcagtccggcatctgtttttaagcttgttaagcagcagcaggcgaccatttttgccggtgtgcctacaatgtataactacttgtttcagcatgaaaacggaaagaaagatgatttttcttccatccggctgtgtatatcgggaggcgcggccatgccagtcgcgttgctgacggcgtttgaagaaaaattcggcgttaccattttggaaggctacgggctctcggaagcatcacccgttacgtgctttaacccgtttgacaggggcaggaagccgggctccatcgggacaagtatcttacatgtcgaaaacaaggtcgtagatccgctcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccgaaaaaaagacatgatcattgtaggaggatacaatgtgtatccgcgggaggtggaagaggtgctgtacagccatccggacgtcaaggaggcggttgtcatcggcgtgccggacccccaaagcggggaagcggtaaagggatatgtggtgccgaaacgctctggggtaacagaggaggacatcatgcagcactgcgaaaagcatctggcaaaatacaagcggcctgccgccattacgtttcttgacgatattccgaaaaatgcgacggggaaaatgctcagacgggcactgagagatattttgccccaataaaatgaaaaagcgaagcggttagcttcgctttttcattttcaatcttttgcttcttttttaataatatttagcagcgcctttgtatcatttttgctcaatttgtagtatgtgccatccttcgaaaaaacggcttgctggctgccgtcaatccatagtctgaatgagtcataccggtctttatgaaacttgattgtcccttcgtaatcaggggctgatgttttttctgtcttcacctgttttccctgattcataatatccagcatatctttgacgtgctgtcttttttcaatctcgatatcttcctggccgcttgaagacagtgtgatcaaatccgcgtctaccgattgatacacatcgcctgatcggctgtaaagataaaaaaatgctataaacacaagaccgattaccacgatggctgccactatttttttcatttgcatcactccaaacattgttagttttcccagcgttcgggctttccatgcttaaaagggtggaaaagtgcggaacacagcttggttctaagaatttgaatttatgattacaatagaagtaacgggttgatgtgaggagtgaggcgttatgcgcaagtggattgcggcagcaggacttgcttacgtgctgtacgggctgtttttttattggtattttttcctgtcgggtgattctgcaataccggaaaccgtgaaagggacgcaggctgatccggcttctttcatgaagccgtctgagttggcagtggctgagcagtattcgaacgtcaagaattttttattttttatcggggtaccacttgattggtttctgttttttgttctgctggtcagcggtgtttcaaagaaaatcaagaaatggatggaagcggccgtgccttttcggtttttgcagactgtaggttttgtgtttgtgctttcgctgattacaacattggtgacgctgcctttagattggataggctatcaagtatcgcttgactataacatttccacacagacaacggccagctgggctaaggatcaggttatcagcttttggatcagtttcccaatctttgcgctttgcgttctcgttttttattggctgatcaaaaggcatgaaaaaaaatggtggttatacgcctggttgttaacagtgccgttttcgctttttctgttttttattcagccggtcattatcgatcctttatacaatgaattttatccgctgaaaaacaaagagcttgaaagcaaaattttagagctggcggatgaagccaatattccggctgatcatgtatatgaagtgaacatgtcagaaaaaacaaatgcgctgaatgcctatgttacaggtattggggccaataaacggattgtattgtgggatacgacgctgaacaaacttgacgattcagaaattctgtttattatgggccacgaaatgggccattatgtcatgaagcacgtttacatcggtctggctggttatttgctcgtgtcgctcgccggattttatgtcattgataagctttacaagcgggcggttcgcctaacccgcagcatgtttcatttagaagggcggcatgatcttgcggcacttccgctgttattgcttttgttttccgttttgagctttgcggtgacgcctttttctaatgctgtctcgcgttatcaggagaataaggctgaccagtatgggatcgagttgacagagaacagagaagccgctgttaaaacgtttcaggatttggccgtgacggggctgagccaggttgatcctccggtgcttgtgaagattttcagaggcagccatccttcgatcatggaacggattcaacatgcggagaaagaagagaatgcgccggaacatcaggatgctgacaaataaaaagaagcaggtatggaggaacctgcttctttttactattattgtgcagctgcttgtacgttgattaacccttttccatagtagaaagagtttcctagatatgttgcagtgctttctaaacgatcacggacttgcgcgtttgtccaagtcgggtgcttagaaagaattaacgctgctgctccggcaacgtgaggagtcgccatggatgttccgttgtaagcaccgtaagtgccaccaggaagtgtgctttggatggatacgccaggagccatcacatcaagctcagaacctgcgcttgagaatgaagctctttggttgctgctgtttaccgcacctaccgcaatagtggaaggatattttgcagggtagccgactgtgcttgagcttccggacgaaccttcgtttccggcagcggcagcaacgacgataccgctggaaacggctttatcaacgactgttttcagcgctgtagaaccagaaggtccgccaaggctcatgttaataacatccatattgttggaaatggcccattcaatgccgttaataatccagctatattggccgcttcctgttgaatcaagcacttttactgcatataatgatgcgcttggcgctacgcccagaacaccgattgagttattaagagcggcaatcgtaccggctacatgcgtaccgtgagaactgccgtcctggtatgggtttgtttcagaaggtacgaagcttgctccgcctctgacgtttaagtcaggatgagaagagtcaattccgctgtcgataacagctacttttacgttagagcctgtgtagccttgagagtgaagagccggcgctttaatttgagaaatgccataaggaacagattgcgcatattcatgtgcaatatgatcttcttccacatatgcaacgctcggatcttttttcaattcttttacagctttttcatccaatgttgctgcggccgcgttaacatacttaaattgcttttgaacctttccgcctttttcagaaataacatcctttttcttggcggaactcatggcactcattgtctgtttaaatccgacaatgtatttcttttctgtactgctttttccggcagcctgcgcagacatgttgctgaacgccatcgtaaagattaacgttaacgcaaacaacaagctgatccacaattttttgcttctcactctttaccctctccttttaaaaaaattcagagtagacttacttaaaagactattctgtgaatttattgtaatagatggaataatattttagtagacccatttttttgagatgattttatctctatttaggtatatcatctctcgctatttccgtagagactcgaaataactattttcatacagaaaagaacgaaaatagacatgagtaaatgttcattatgctgaaatgtcatgcttttttaggttaaatgctcctgagtcccggcaaatttctgtcgaaaaaattcgttcaaatgacctgcgtgtgcttccgtgagaacaatggatattatcgtgatattttttcaaagcatgatgataaaagtattctgaaaaataaactttacagaaaagggatagaatgaaaaaattattgagagggaggaagaaataagatgaacattcgccaagcaaagacatcagatgcggccgccattgcgccgttgtttaaccaatatcgggaattttatagacaggcatccgatttgcaaggggcagaggcttttttgaaagctcgtttggaaaatcacgagtctgttattttgatagcagaagaaaatggagaattcataggctttacccagctctatccaacgttttcttctgtgtcaatgaaaaggatatacatattaaatgacttatttgtcgttcctcatgcgcgtacaaagggagccggcggccgactgctttctgccgcaaaggattatgcagaggaaaacggggcaaaatgtttaacacttcagactgagcaccacaaccggaaggcaagaagcttgtatgagcaaaacggctatgaagaggataccgcatttgtccattattctctcaatgtgccggcgaagtgaaaatggcggcttgatgatttggttttttgaacgttcttcggttacgatataaatgaaaaggagtgtgccgaatgtcaacgttatttcaagcattgcaggcagaaaaaaatgccgatgatgtttcagtccatgtgaaaaccatatcaacagaggatttgccgaaggatggtgtcctgattaaagttgcttattccggcattaattacaaagatggtctggccggaaaagcaggaggcaatatcgtcagagagtatccgcttattttaggcattgatgctgcgggtacggtcgtctcttccaaagatccgcgttttgcggagggggatgaggtgatcgcgacaagctatgagctcggtgtctcccgtgatggcggattaagtgaatacgcttcggtgcctggtgactggctggtgcctttgccacagaatctttcgttaaaagaagcgatggtgtacggaacggcgggatttactgcggcgttatcagtgcatcggcttgaacagaacggtctgtctccggaaaaaggcagcgtgctagtcacaggagcaactggcggtgtcggcggaattgcggtatcgatgctgaacaagcggggctatgatgtggtggcaagtaccggaaaccgggaggcggctgattatttgaaacagcttggtgcaagcgaagtaatcagcagggaagatgtctatgacggaacgcttaaggcgctgtccaagcagcaatggcagggagcggttgatccagtcggcggaaaacagcttgcctcgcttttaagcaaaattcaatacggcggatctgtcgcagtgagcggcttaaccggcggaggagaagttccggcaacggtgtatccttttattcttcgcggagtaagcctgctcggaatcgattcagtatactgtccgatggacgtcagagccgctgtttgggagcgcatgtcttctgatctcaagcctgatcagctgctgaccatcgtggacagggaagtatcattggaagaaacgccgggtgcgttaaaagatattttgcaaaatcgcattcaaggaagagtgattgtgaagctttaacaagatcagcttgcagagaatgttatttttctgcaagcttttttgtggacaggctgatcagctgctgaactgctgtgtcgcgaagcaagattttcatgtaagcggaactttctcttcccattttaaaaataattggtgataatgattctcattccgtgttatactactcttggacatcttaaccatagaaactaccaacaggagagactggaacatatgaaaaaaacactgattattcttacagttttacttctttctgtcttaacggctgcttgctcgtcttcaagcggcaatcaaaacagtaaagaacataaagtagcggtaacacatgatttagggaagacaaatgtgcctgagcatccgaagcgggttgttgttcttgagctaggttttattgatacactgcttgatctcggcattacgcctgtcggggttgccgatgacaacaaagcgaagcagctgatcaacaaggatgtcctgaagaaaattgacggttacacatctgtcggcactcgctcacagccaagcatggaaaaaatcgcttcattaaaacccgatttaattattgctgacacgacccggcataagaaggtgtacgatcagctgaaaaaaatagcgccgacgattgcgcttaataatttaaatgctgattatcaggatacaattgacgcttcacttacgattgcaaaagcagtcggcaaggagaaggaaatggagaaaaagctgacggcgcatgaagaaaagcttagcgagacaaagcagaaaatcagcgcgaacagccagtccgtgcttttgatcggaaatacaaatgatacgattatggccagggatgaaaacttctttacatcgagacttttaacacaggtcggctatcgatatgcaatcagtacgtcaggtaatagcaattcaagcaatggcggcgactctgtgaatatgaaaatgacactggagcagctgctgaaaacagatccggatgtgatcatcctgatgacaggaaaaacagatgacctcgacgccgacggtaaacgcccgatcgaaaagaatgtcctttggaaaaaactgaaggcagtgaaaaacgggcatgtataccacgtggatcgtgcggtgtggtctctgcgccgcagtgtagacggggcgaatgccattttggacgagcttcaaaaagagatgccggctgctaagaaataaaagaaaagacaggcaaacgcctgtctttttcttatttgataaagccggataagtggctgttgatattatagtcttttatccgccatttttcttctgcaaattcaatgttgctgaggcaggcgttgacgagacgggtgctttgaagctccgggtcaccgccggatatttctgtcagcagggcgtgaattgccgcaccgtgcgccacgatcagcaccttcttgtttggatacgcctggttcacttttgccaaaccgcccatcagcctgtcagtgagttcttctaaggtttccatattcggatagatgttatctggatagcgctttgtccgttcctccagcggcatgccctccgcgtcgccgtaatcgcgttccttaaaatcatccatctcgactatcggaagatgcagatattcattaataatatccgcggttcttttcgctcttttcagcgggctcgtcacaataatatcccaagaaaagtcctttacatattctccggtttctcttgcttggcgttcacctgttgcgtttagcgggatatcggttttgccttggcatttttgctgcaggttccaatcggtttctccatgtcttactaaacaaacggctgtcataaaatccccttcctgactttattcatatcgctattatactaaatcgaaagcgtgtgtcctatgaaaaagcctatgcaagaacttcaaataataaagccagtccgattccgccgccgcttccgatggctgcaacagcatattgacagtctggccgtcttttcgcttcataaaacaatctggttaccagagctgcacctgatgcaccgtacggatggccaagagctaaggcgccgccgcgcacattgatttttgaaaagggaatgccgagttcttgcgagcagacacaaattttgacggcaaaggcttcattgatttcaaataaatcgatatcatcaggtgttacatcgtgtgtatgtaagagctgacgaatcgcgacaaccggtgccgcgggcggaaagttggggtgaatgccgctgacagcgctgccgataaaccggagcacaggcttaagtcccagggctgccgctttttcttcttccattaccaaaagagcggctgctccgtctgctatgccactgctgttggctgctgtgactgttccggagctggtgtcgaaaaccggctttgcacggggaataatcgcttttatcggccgcgttttcaaaaatgcttcgtccgtctccaattctccgagaggaacaatttcttcacggtaaaatccttcatcatgcgcgttcctgctgcgttgatggctgagaagcgcgtactcatcctgcatgcttctgctgatggaatagcgtgcagccgtatattctgctgcaatgcccatgtctggatcgccaatcgcatctggagaaaagcgggcccgttctgaaaaaggggattggctgctgctttctgagccgcccgcgatatacatcgtgccggctcccgcttgaataaggctgcaggcatagcgcacagcttcaaggcctgagccgcactgtctgtcaattgtcattccgggaaccgataaaggcagtccggcttgaagggctgacagtctggccaggttgccgcctctgccagtagcgtttccgagaatgacctcgtcaacttgatcctctagctttcggctgagacagcggatgatgggagccgccaaatcctccggcaggaagggcttcagcagtccgttttgatttccaaagatcgttcgttttgcatcaacaataaccgcattcatttatactgtatactctcttccagccattttttcactctggaacgggcaatttttccgctgctcgtttccggcaagctgtctgcaaacacccattttttcggaattttataggaggctaatttctgtttacaccattctttcagtgttctggcattagcgtttccaagaatgacagctacagcgatttctccccaatactcgtcgggaatgccaacgacagccgcgctttcaacctctgggcaggcgagaagcacacgttcaatttcttctgggaaaatatttaatcctccgtacacgatcatcccgttttctcttcctgatatgtaaagaaagccctcttcatcaacgtagcccatatcatctactgtcatccattcatctggtgtgctgccgttcacatagccggaaaacctcatcgggcttttgacaaatatttttccgatttctcctggctggcagcgttctcctccagcgttgaggatttcgatccggacattatgaaaagggcggcccgctgaatgcggcttccgtttgctgtcttccggtgaagaaaacgtcacaaaactaagctctgatgtgccgtaaaaatcgtacagcttgagatgaggccatgcagcggcaagcttctccttggattctgccggccagtctgcgccggatgaaatgattttgacgggactgtcgggaaaaccctcaatccttgcgagggcgtctgtcatcgtcggtacggtatagagaacactgatggattcacggcacagccattccttcgctttggcaggagaaaactttttcagcaaacaaacggttcctccaagaaacaaagtgctgactgccccgtataagaagtgagaggacattaacgtcccgggaatcaataccgtgtcatttgatgaaatcgaaaaatctgtttctgtacaggtaaagctctctatccatgagcggtgagatcgcctaaaggccttcggttttcctgtcgagcccgacgtaaatcccatataaaaagggtgctccggatcaatggtaggcaagggatcagcggttgcttcagaaatatctgccatacagttatccagcaaaacaacaggtgtctggctatctgtcagtttgtttttgaaaaaggctaaagtaaccacaagatccgcattgcttatggacagccgctccttacattcagccgggctccagcgtgtgtcgatgggaatggctgtgcatccagctgctgcggctccggcaaacagctgtaaaaacgccagactatttgggagcaggatcgccacacgattcggcatgctcggctgtgaccgcagccaatttgcggtttgagagacaagccgatcccaatcatggtacgtgatttgctccgaatcagtctggatcgctacacggccgggcgatgtttcggcagtagatgaataggtatgagtaattgtcatgtagtgtcatcctccttttgtaaacatcgtatcagaaagagacaaggcttgagtgatttttatcgccagaaatgcagatacagccgcttttatcaaatcaccaggcacatatgcaaggctcatgaaggcggcctgtgacaaatcaatatgcatgataaaagcttgtaccggtataccaagcagataaataaagatgatgccgaatacgatatgagtgaaaaagagacgcaatactgtcaccttccgcagcctgttagcggctaaactgatcagccatgaagcgaggggataagcaatcaaaaagcctgcgctcggtccgaaaaacacaccaaaaccgcctcgtccgccgggcagcagcggcgctccgaaggcgacgagcagcaaaaagacaagctggcttaagaaagcagactttggcctgagaatgctgcctgccaacatgacaccaagtgtttgcaatgtaatcggaacgggtgtaaaggataagaagagagggggcataaagccgagcactgccatcagcgcggtgaaaatcgcaatatgcatcatgtcgattaatttcagcatgtgaaatcctccaaacagtaatcaaatatggttatacaataaatgcaggtaattattatgtcaacttatttttaatttgagtttacataatgaacgcaaaaaaaccggccgtatggcagaccggtttttgatggttattcttctgtcaggatgacaagcgaatcaacggaagcggccacatgggaaacggcgcggctgacttcctgaagccctccaagaaaggcttgcagatcgacgtcgattttgcctgattgctctttgctgattttcatgctgtgaacgatttcatcgaataagcggttaatttgcgtcattttttctttactttcgctgactagctcattcacgtctttgatatgcttggatacaatgttgatttgtgtattcgtattgttcacaagctcagaaacagtagagacggtttttttcgtatcctcagaaagcttccgcacttcatttgccacgacagcaaagcctttgccgtgttctccggcgcgggcggattcaatagatgcattgagcgagagaaggtttgtttgttcagctatgcctgtgacgatgccgaagattttttcaatttgctgcgcgatttcatccagcttgaccatttctttttcgatttggacaaggcttgtgtcaattttgttcatctgtttttgctggacttctagctctttttttccgccgatcgacttttcttcaacagtgctggatgttacagtgccggctttggatgcttgagaaatgccttcagatttgtccacaagctcttgaactgatctgcttgtttctgaaaacagattggcaatcgatccagaggtttcttgaattttctgatgaagaaggtttttcttttcttcttgttcatcacgggtttggttgtactcgctttgaaacgcttcaaggacaagctgctgttctaagttcaagatttttgttgttgctttaatggcttttagcagttcttgctgatttgtaatggatgcttcataaatgtcaatcattgacaaaagaagctcttgaaacgcacccatataccattttggcaaaaggccgattcttaaatggatggaggcgattcggttacgcttttcaatgaattcatcatcgataacgcctgcaaacatttcctgaatatgccgttttaacgtttgttttaagcggtcaactgagctgtgatcattaatgatatccatcaatgagctttcatggtcaaggtttttataaaacgcatcaacgatatttacgatattttcttgaatgagtggctgaagctgctctaacacgtaaagctcagcatctcccaacctgaccattttgagctgttttttgacatctgcatgtttgtttgtgagctgaatgcggtttttttgctgtccgtttgaatctgaaaagtaagctgtttcttgttttctgtcttttttaaataacaatacaatgatcccccttgggaaaaatataatttttactttttggctttttaagcctttttcttttttatcggccaagggaaacatgaatgaagctgcagatgaaaaatatttgaaaaaccgttcattaaaatgaacggtttaatcgagatctatttgttttaatggtttaatggccggaccctctacaacttcgccagatggcttaaagcgtgacccgtggcacggacaatcccacgtatgctcactgtcgttccactcgacctcgcagcctaaatgggtacaagtcgtatcaacgagatggaggcagcctgtctcatcccgaaatgctcccgctcgcctgccgtttatggtgacggctttcccttctcctggcgaaatgtcttcaaattggacatcaggcttttcaagctttcctttaatcaaatgcttggcgacatcggcattgtaggaaatcactttctgcaacccgggattcagatggaaacgggacggagtgaaaatgctttcgtatggattgtcttttttctccacaaggtctgacaatagagtggctgcgactgctgaggacgtcatgccccattttttgaacccggtcgctactagaatattgtcctcattttccgacatcggcccgataaacgggattttgtcgatcgtcactagatcttgtgtggaccaataatatggaatgctttcgatgccgattgtgctttcggccagttgtctcagtgtttcataatgtgtagacatggcttttccctggcctgttttatggctttctccgctgaagagaatcagcttttcaccgtttacaaccgtatagcggagcgccactgacggctgatcgatactcaaatacatgccctcgggatactcgatcttcggcttgatggcaaggacataagatctgtcggagtacattctcgcagcatataatccgcctccgtcataaaaagggaagtgggaacagcatatgataaagcggctcttaatggcgtgccggctttttgttaccacttcgggcctttcgccttttttgatatcaagcgcaacggtctcttcataaattcggccgcctttttgaacaatttgctccagaagcgcttttaagtattgaagcggatgaaattgtgcttgattcttcatgacaagcgccagcttagaacctaagggaattggaagatccttgataaggtctctttcaattccgagctttgtgtatgcctcatgctcggtgcggattttttgaacagcgttttcatttgccgtataaagatatgcgtcttgctcgatccattcacaatcaatttgatgttcatccacaatgccttttatgtaatcaattgcgttttggtttgcttcataataaagcctcgcatggtttaatccgaaatggcggataaattcgtcgtatatcatgtcatgctgtgcggtaactttagcagttgtatgcgcagtggttccgttaagaacctgatttgcttcaatcaaaacgacacggaagcctctcttcgtaagttcatatgccgttgtgattcccgtaatcccgcctccgataatggtgacgtcacattcagtgtcctcttgaagcgcaggaaaagaaggcaggtcagttgatgttttccagtatgtttcaggtgcttcctttgcaaaatgttgattagccaagccgttatacctccaatcagatttattcttaatttttccatattctatcttttcatacataggaagcaggcattgttcataacataataaggttgaaaaggagtgatttcattggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcgggattggacgcgctgtctcggtgttattcgcaaaagaaggggctaatgtggtcattgtgtatttgaatgaacatcaggacgccgaggaaacaaagcagtatgtagaaaaggaaggggtaaaatgcctgctgattgcaggagatgtcggggatgaagcgttttgcaatgatgtggtcgggcaggcaagccaagtgtttccatccattgatatattggttaacaatgcagctgagcagcatgtccagccaagcattgaaaaaatcaccagccaccagctgatgagaaccttccaaacaaacattttttccatgttttacttaacaaaggcagtgctgcctcatttaaaaaaagggagctctattattaataccgcttcaattaccgcctataaaggcaataaaacgctgatcgattattcagcgacaaaaggcgcgatcgttacgtttacaaggtccctttcccagtcgcttgttcagcagggcatacgggtcaatgcagtggcaccgggtcccatttggacaccgcttatcccggccagctttgccgcaaaagacgtggaagtgtttggttcagacgtgccgatggaacgcccgggacagccggtcgaagtggcgccaagctatctataccttgccagcgacgattccacatacgtcacagggcagacgattcacgtcaatggcggaacaattgtgaacggataataaaaagccaatccttgaaggattggcttattcgctctgcttgagcgctgcatattctttagagagcgtaagaaacgcatctttatctttttcgtccaaggctttgttaatttggtccgtcagcatggcaagccgacggttatacaaggattcatcgagcaccatttgaatgtaaatatccgtcattgtgacatcgaattcttttgttttttgcgtgttgcgggacttcatgagctcagtgtacgattttttctctttcataaagaatccccccaatgccttttttatagtatatggataacggtcgaaaaaatcaataaatttttataatttttagacaactaatacttggcaatctatcgacatatcctgcaaaatgccgtaaaccggcaagtcttatgaaagtaaaatcggtttattactagtcatttagtactattaaatatcattaaaagatgattttatcttaaatgttaaaaaaacctgtcgttttacaaaaacagatgatagattattagtataaattttgcagaaaaaggatggaggccataatatgagtcagaaaacagacgcacctttagaatcgtatgaagtgaacggcgcaacaattgccgtgctgccagaagaaatagacggcaaaatctgttccagaattattgaaaaagattgcgtgttttatgtcaacatgaagccgctgcaaattgtcgacagaagctgccgattttttggatcaagctatgcgggaagaaaagcaggaacttatgaagtgacaaaaatttcacacaagccgccgatcatggtggacccttcgaaccaaatctttttattccctacactttcttcgacaagaccccaatgcggctggatttcccatgtgcatgtaaaagaattcaaagcgactgaattcgacgatacggaagtgacgttttcgaatgggaaaacgatggagctgccgatctcttataattcgttcgagaaccaggtataccgaacagcgtggctcagaaccaaattccaagacagaatcgaccaccgcgtgccgaaaagacaggaatttatgctgtacccgaaagaagagcggacgaagatgatttatgattttattttgcgtgagctcggggaacggtattagaaaaataggaaggagctgaccgaacagggcagctcctttcataaagctatgccgtcggaattcccccggtgatgccatatacctgagatgtcacatagcttgaattctctgaagctagaaatacataaacatcggccaattccactggctgaccagcgcgatttaatggagctggcggcgtgccttgtccgaatttcgggatgttttccgtcggctgtccgccggaaatttgcagcggtgtccaaattggtccgggtgcaactgaatttactctgatgcctttggaagcaagctgttttcccagtccaacggtaaagccgataatggcgttttttgttgctgcgtaatctaacaacatcgggcttggattatagccttcaactgaggtagttgtgataattgaagctccctccggcaaatacggaagcgccgcttttacaacccagtaaagggaaaagacgttcacttcaaatgttttatagatttgttcagtaggcagatcttcgatgttttcgaccgcttgctgtttgcctgcaacgagcgctagcacatcaagtccgccgagtttgtgatgcgactgtttgactagatcttggcaaaaggattcgtcgctcaaatctccggggatcagcactgcttttcggccttctgcttcaatcagctcttttacctcttcagcatctggctgttcctcgggcaagtagttaatggccacatcggcaccttctctggcgtaagcaatcgcggcagcgcggccgataccggaatcgccgcccgtgacaagcgcttttcgacccgttagtttacctgatcctttgtagcttttttctccgcaatcagggacaggcttcatgttcttttgcaggcctggcggctcttgatattgttcaggaaattcatcatgaaaaaatgcttttataggattcgtaagatttgaatcagacatcagcaacgctccttttctgtttggtgtacattcgtatgtgtacccctgagcataagcagaaaaacatgttttggcagtttgaatagtgaaggaaaaagaaaacaagaaaaaacaaagacttcttccatatttatcttgtcaaataagactatatgaattatgataaattcgagctataaatcaactaaatattgggtgttgggggagtgaatcgtcatgaaaaaagcggccgcggttttactgtcactcggtctcgttttcggtttttcatacggagctgaccatgtggcggaagccaaaacaaaggtgaaggtctataagaactgcaaggagctaaacaaagtatacaaaggcggagtggcccgcacatcgaaggtgaaaaacaaaggcggaaaaacgaagtacaagccttacgtttctaaggcgctttacgatgccaataaaaacaaagaccgcgataaagatcttatcgcctgtgaacggtaaataagaaaaagcaatctggtgtccagattgctttttttatgcttatgcagcctgatcggccgcagcgcttttcgccttccttgtcataaggctgactgccatcatgaccgagatattcaaaagcagggcaacgatgccaacattcaggtcttttgcggcttgcggcagcgccggaaataaagtgccgatcgtcgtttccgtcattgtaatataagtaactgctccgacacctgcaataatgccggcgaaggctccttgctttgtcaccatattatgcttgaacaggctgaacaaaagggcggggaatagctgtgtgacaaggctgtagcccatcaaaagcaacgtaacgatggtattcccgcctttgaaggtaaaatacaccgaaatcaacgcaatcaccggcactaaaaacttagcaagagccgatacctgttgttctgtcgtgcggggcgcaattaccttgtacacattttttgcaaacagcgtggaggcggacattaagatcatagaccctggcacaagtgctgtcagcagtccggcagcaccgataattccgacaaaccaagggtcaaatgcttgcagagacagtctcaaaagcgatagatccccgtctgcgcctttcagatctggaacttgcaggatagccgcgaagccgacgaaaaggacaaagagcaggaccagctggtacaaaggcatgatgatggcgtttttacgaaacacttttgggttttcggctgaatacgaagcggaaaacgtgtgaggccacatgtaaaacccgagcgctgtcaagagtacggttgaactgaaccaggccacactttgtcccgattcggggagcgtaagaaagccaggctttgccgtttcaatctgctgaaacatgtcttgaaatccgccgtagtaatgaattggcaaatacacacctaaaaacagaacgacaaccagaatcatgatgtccttcacaaccgatatccaggcagacccgtgaatgcctgaaaccataacataaaccgtgatggaaacagcgccgatccagatggcggcggtcggggtgattttgccgtacgaggtttccgatacaatcagcccgaggcctttcagctgcagtacaagatagggaatgagtgcggcgatgccgaccagtgaaacgagaatgccaagcagcggactgttgtatttttttgtgaaaaaatcagactgcgacatcagtttatgctgtttcgcgtacgtccaaactgctggaagaagccagtaagaaaggatgtaggccagacatccgtaggcgatgatataaaaggctggaccgccctttccgtaggcccagccgctgccgccgagaaacgtaaaagtagtataaatttcgcctgccatcaaaaggaagacgaacacagttccgaagccgcgccctccaaccgtccactgctccaggttcatgtcttttcctttttgggcgcgtataccgagaaaaatactcaagagcaggataccgaaaatgatgatgagagctgcattcattctgcttcctcctttttattttccttgtcgaggacatacacaatcgccatcagcgcagaggtcaaaagagcccacatcacaatataggcaagaataaacggcatgccgaacacatagggggtcaccttatttgcaaaagggatgccgagtaagattccgataaagggcaaagcggcaagaacgtgaatcagtttcatagaatcctccttctatttaggattggggtgtacaagcccaagcgtactgaaaatgatgtcgcagatatggcagcacatgtcactttttagggtgaaaggctgtggttcgaattataaataaatttattttgtttgtatagtgtgaattgtctgaaattaatgctttgaatcgcccgaagagggaacgggcagtatgattcaaaaggctcggagtctgtccggggcaaatagatagtatgttaataattcgctgacctgctcacggattcgcggattaaaatagcgatggttttcttcataaccgtcgatgacaaatgtatagagcgtaaaggcttcatcgcgttccgtctcgcggattgcaatttttcttttcctcagttcttttctgacctccatcaaatccttttgtgctatttttaatgattcgctgataagctgtttataaggatgcttcaattttaatgtgctttcttcaattccggcgagatcacggttaaaaatcgtaatggccatgggcaaaaagagagcccgttcaattaaatcgtatatttcctcctgcagatttggcatattgactccttctttctaagggaacgtttgttctatttgtattctatatcggctggtgaaatgtttcaagacagaaaaaatcaccaaaactttttagttttctgctgataatgtgtagaataaggatagacaaacccggtaaggagtataaatgttggagcattttttatcctatttgacacaagaacatttaactgaattatttcaaagctatagggctttcggtccgctcatagctgtgctgctgcctttaattgaagcatttctcccgtttttgccgctgatcgtgtttgtggtggcgaatacgaactcgtttggcttgtgggaaggattcatcctgtcctgggcgggatcaactgctggttccattctcgtatttttgattgtccgtcaatacggacagagaaaattgcttggatttatccgcagtcatccgtctgtaagaaagctgatgttatgggtggaaagacacggcttcggtcccatgtttcttctgctttgttttccatttacaccgtcagccgcggtgaatgttgttgccggtttgtcaaggatcggaacgcggccgtttattttggcggcagcctcggggaagcttgtcatgatttttatgatcagcttcatcggatatgatctgcacgcgctgattacacagccgattcgaacggtcatcgccgtattggtgatcactgtcttatggtatgtcggcaaaaaggtggagcggtatctgcatgtaagagccagtcagcgtgagcatgatggagggagacagtaacatgaaaaaacggttttggtttcttgccggtgtagtgtccgttgttctcgccattcaggttaaaaatgctgtctttattgattacaaggtagaaggcatcagtatgaacccgaccttccaggaaggaaacgaattgttggtcaataaattttcgcatcgatttaaaaccatccatcgttttgacatcgtcctttttaaaggtcctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaataagcaaggtgccgaaaggaaaatattttgtcgttggagataatcgcatatacagcttcgacagccggcattttggtccgataagagaaaaaaatattgtcggtgtgatttctgatgccgaataaaaagacgctaattgaagaggcgtctttttgtatgccgtttggaaaaatgtgttgaagaaaaatttgtaaggagctataatcaaaattgttacctatgtaacaaaatttatatattttttgattagaggaccgtttttattggtttttgttcgtttttcatgaaacaaaaggagtggtgaatgatgatgaaatatgaagcagtgattataggaggagggccggttggatttatgctggcttctgagcttgcgatggccggagtgggaacatgtgtgattgaacggcttgaaaaacctgttccgcattccaaggcgttgacgctgcatccccgaacgctggagctccttgagatgagagggattttagagcggttcgtatccaagggaagcaagataccctccggacatttttcaatgctgggtacccgtctggatttttcaggcttggatacgagctgtccttacacgcttttgcttccgcagtccaaaacagaaaagcttcttgaagatcatgcacgaagcctgggaacagaggtgtttcggggtgcagaggcgctggcggttacgcaaaacggggaagcggtccaaacgatttttaaggatcgggacggcagtgtacggacgatcacaagcaagtttgccgttggggcagatggcgccggaagtaccgtccggaaacaggcaaaaattgagtttccgggaacagacagcactgtcaccgctgcgcttggggatgtggcgctcctttctccgccgccgtcaggcgtgctgtccctttgcacaaaagagggcggtgttatgattgttccgttatcttcagaccgatatcgtgtcgttgtgatcagcccttatcgcacgcaaacgccgaaagatgtgcctgtgactgaggaagagctgaaagctgacctcctgcgaatttgcggaactgactttggtttaagcgatccttcgtggatgtcgcggttcgggaacgccgcgcgccaagcgaaacggtatcgggacggcagaatctttcttgcgggtgatgccgcgcatattcattttccagcgggcgggcaagggctgaatgtcggccttcaggatgcaatgaaccttgggtggaaactggcggcggccatcaaaggctctgcgccttcatggcttttggacagctaccatgacgagcggcacccggcagctgaagggctcctcagaaacacggaggcacagacaaagctgatcgatttcactcaagcaggcctccatttgcgaagcatgatgtcggagctgctggccttccctgatgtgaatcgatatgtagcagggcaaatttctgcactcgatgtcagatatgaagctgatcgtaccatgccgccgaatcgtttgaacggggcaaggctccctgacatgaagctgattctttccgacggcaattcggaacggctgtacagctttctccaaaacgggacattcgttttgctgtcattgaggcaggaagctgatgatcatatcgaagtgaaaggcttacgtatggtaaccgcctcgcttgcagaaccgaatgaaaagttgcgggatgtgcataccatattgattcgtcccgatggacatgtagcctgggcggtggatgcatcagcgcccgattgttccgaggtgattcaaaaagggatcagccgctggttttccgtcaccagccgagtataattcaattcgattgtttcatctgtaacaaaacggtatgatagaagaaacaatcgaatgaaaaaggatggaaaacccgatgaacacagatcatacgaaacgcaatctttttgaattgtatgcggagctcattcatcaacaggagaaatgggaggggcttattaaagcctttttatctgacgaattgaggaagctggatgtagagcacgggagtaaatctcaattgacgatgacagaaattcatattctatcctgtgtcggggacaatgaaccaattaatgtcacgtcgatagcagaaaaaatgaatacgacaaaagcgactgtatcacgcatcagcacaaaattgctcggcgcaggcttccttcacagaacacagcttagcgataataaaaaggaggtctacttccgattgacgcctgctggaaaaaagctgcacagtttgcacaaatattatcatcagaaggctgaacagcgttttctgtcattttttgaccgctataccgaggaagagattctttttgcggaacggctgtttcgggatctggtgacaaaatggtatccgtcgtcagaagaaattgaaggggggcttcctagcatttttaaataaaaaacacgcactgaggtgcgtgtttttcacgtttcttctttctttttcaagattgtaacgtaaatcagatttcctccgactaaaatcataagcggcagtccaggggagccggatgtcaccaaattataaatcagccagattcctaaacatattccataatataagtgcattgccttctcgggattgtcgcgcagcaaacttcctttaataatctttttcatcatatcgcccctattaattttaggatttccctttagtttacatgcatcttcggttcatctcaaaatttgctctttggcttttgatgctctcaaaatatttcgagggaattttagaattatttttttacagatatgttttctgatagctctgcccacttctatcatctactatctcccttgctaaaacactgttttctccatataaacaaggaaagaccttctgtagcaagccacctatttagtccttttatttcctcttgggaggaatgtctcgctttctatttcggctaatactcccatagaatcaacaaatgtaatacttgtttcattttcacgcataagaattttcgtacccccacttaatagaccctgtcatttctcagctaagtctgttgttaacttgctaatatcttctgcagagatgccgtaccatccaacaatacgttatgaatcaacctattctgaaattggtcagagatctctagaatacccaagtaacttgtgattttactttctaataattggaaccactgatctttttcactcaatgtatcttctatatatataaatttgtacatgtatttacctcaattcattcatttgttttatttttatttgaaaagtaaaaagaggacattaagtcctcttcttacttacgatatgtctattagtatctttcatttacacgtgtttttgatgctttgttttcaagtgaaatagggtcttctgttttagttctcctaatctttacagaaatacctactagaatgaccgccatagttgtaaatattcccatggttaataagatcgtatcctgatttaaactccatccaattaagaaagagatgatcgctcctccgaaacttgccgaggcaataaataaacttgtaacttcgtcaacgtacttctgaataatgattgatgctagtgttaaagcaatgggaaatatacccgctatacttaggccaatcaaaaatgtaccacccaattgaagtattgggttacttatataagagaaggcaatcaacaaaacaattaaacaactacagctaaaaaggaggtatttggaaaaatcgagccttctacttacgaaaccaatcaatattcttcctatgatgatccctacccagaaaaaggagacacttataagactaatttgttcattgtcttggtttatcatgattgaaggtaaaaagttggcaaaatttgtttcaattccagcatataggaaagcaaaaaatacaaaaaagcctaattgctttgatttttttctatctcctataaagtattgaaatgctcctccatctggaaaggtcacttgttggttagcattcttagcgtactttcggttcttggacaagaaaattaaccaccctacgaataggacgaataaaaaggtgaatatacagtaatacggtaaaaaccagttattgatatctatgaaggaattaattaataatgggaaagataaagcacctaatccaaagagaacttccagcttactcattttttctgcattactttcgaaattagcaataacaaatgaaccaactgtcgtttctaatgtgcctgccccatatcctaagagaaaagccattacaacaatataataccaatccttagttagaaaaaagatacttaacgctacaagcattattgtcaaagctaaagtaagtgtcctaaaatgactgtatttcttaatcattaacggtgcgattaatactccgcttagaaatccggtaaactgaaagaagattatgaccgaaatatcatctgttgtcttgttaaaagcctctaatagaaatggtgtcaaactccctgttgatatatggataatacctactgtaaaaaagaaagcatatccgaataaatatgtccctcttaacattcattacacccctatatgaaaaagcaggaaagtaaattcctgcttttttagtaacttctctctttgaaatactagttgactgctgaaacagacattggttgagagttgctgtctttctcaaagaacatttctaacacttcctgagatctaaaaccatcactaaaagtagggatctcaacccaatcattctgagttgatgcaatccaattgattaactcgcttctaaaagaatcagcccatccataaaactcgtttggcggatcgtttaataggctttgcggtactgggcagtctaccacgttcaagccatctatgagcttgtaaacgtgaggattacctgtgtggtatttaaactcttttttgtgtccaactacctcaatgctaaaaccacagtcttcaggtacagaacactttgatgtgatgatatttacaaataccttgttcttcagctggccataaatttctgcatagtcatctacaagtacctgtttatcctcttttgtttttacatttgtgttcatctttgcccttactgattctgtgatgaaatcactctcgaacaaataccataccatgtcaataaggtgaatacccagatcccccaatgatccactcgtcttcttactgttagcgtcatctctccaagtaaacttcttacgtctaagtgcactatttttcttgaagtgtacttttatggacaggatgttacctagttcattattgataattaagctttttaagatatttacgtaagataaatatctataattaaatcccatactggctcttacgctcaacctttcagcagtatctttcattatgcttgcttcttcaagagaaatagccataggcttttcacacaatacatgcttatgttttcctaatgcttgcaaagcatgttctttatggcaaaagtttggtgatgctacaattaaaccttctgaggcatcaattagttcatctacgttttcaaatgacttcccgccgaaagttttcacaaagctttctgcattttgttgatttatgtcatatacccctaccaactctgcattttttattgtagataaagcagttgcatgcgctcttgcaataccacctgcacctatgatgccgatcttcttcatttttatttcctcctcatgatccaattaatttttttaaggtattagtaattccttttgagtactcactatcagttataaggtggtgcaagtttttggcttcctgtgttgcattttttagcagatatccattccctactgtctgtaacatacgaacatcatttccactatccccaaatgcgatagctctttcggtatttaggttgtatttctctaacataaacgttacaatttcattctttcctgtccctatggggataaaatctacatcatagctgtcttctggatcgcctgctaagggattacaccgatttatatttactgaaacgccgtattcttcgcagattttttcaattgctaataggtttttcttgtcgtttatttcatcttgttcctgatagtagaagttatgcttataccgtgactttcctaattgagtttgaggattcaaaagaatgttatgattttcatgcagctgtttcacaagtttttcaaccttttctttactaaacccttcatttatgcgactgttccacttgttatcttgctgaccgaagttatgctctgaaaagtacgtaatttcagttccaagatcactagctataaaatgcggaaaatatctaaattttcctcgtcccattttatcgataatagattctatactgctccctgtaacccatccgattattagttccccatctttacttttttgttctagatagtcttcgagttcataaatgtcttgttgtttttgttcgtcgattgtatgcggaaaatacgtttcatcaaaatcacaaaaaacaatatactgaggatgttcaaccgtggataacgttttatactccgatttcttgcttaataacatgaaacagtccctccattactctgtcttgttcttctaaagtaaatgacggatataaaggcaaatgcagtacctgactatgagccttttccgtatgaaccaatgggagtcctgcatacttgtcctgtactaaaggagttttttgcatatgagacagtactggataatatacatctgtttgaacaccaaaatcttcatttaatttagtcatgatatctgctctatcttctgttctcaccttaataggaaacagatgccatacatgatcttcacttaattctggtaattcaataaagcctttattctgcaactctgctaattgggtaatgtatctatccgccaagaacagtcttttgaagttgtttaatgaaaggtacttcattctctctaaaccaattgctgcctgtaaattgtccatttttgaattaaatccaaaattgatgactttcttattttttacatttacttcaaaaccatgataactaaattgaatgcattttttagcgagttcttcattatcagttgctattgccccagccttgccacatacacccaaattcttatagggattaaaacttaatgtagtgatgtctgcatactttcctaagtctgtcagtccaattccttggcaggcatcttcaattactttcaatttataacgatttgcgatttgacggatatgctgcatgtctgaatgttttccgtataaatgcacaggtagaataaactttgtataaggagttattgcttcttcaattttgtcaggatcgatgcagaatgtttgtgggttaatatctacatagataggaacgcctcccaaagctaacacagcattttcagtagctgaaaagctattagccggcatgataacttcatcccctggttttaaccctaaagccaataaacctatcataatagcatcggttccactgctggttgcaattacataccttttatgtaaatatgtagataaaactttttcgaattgctctaaatagggaccactcgtaaattttccagttggcaaaacttcagttaatgtatttaagatatcttccacttcatcattggttattaatctgtctacaggcaaaaaagggactttactgatttcacgatttttttgatagttgaaaagatcatgttcaatatctatcttttcttttaatacttgtttccaccgctcgtttacaatactgtcttcaataacaagttcttttccttgtacgtcaccttttaagtgttttaatagtgacatgttttctttgcttttacctgaaatcttaacctgtttttgcatgaacagtacctccaatgattttataatctaaaaatttattacaaatttatcctaatttctgaaatcggtaacatgtcaacaacttttttaaggaagggaaaatatgcctacaattgatgaaatagcaaaattatgcaacgtgtctaaaaccacagtgtcaagagtattgaataatcatccttatgtgtcgaaagaaaaaagagatatgatcttaaaggcaattaacgaacttgactacactcccaattatttagctcggaattttaggagaaataagacacaaacgatagctttatcggttccgagtatcgaccatccattttttgctcaattaataaaaggggtctctcatgaagcactgtttaagaattacaaggtaattgtatttcagaccttttatgacaaacagacagagctagaattgttagagttattgaagcataaagaagtggatggtattattcttggaactttagaaaatgaatgggatcagatatcccctttcttaaagtatggtcctatcttattatgtaatgaatatcatcactcagcggacatcacgataattgggtatgatgaatttgaagctacatacatgggggtagtacatttaattgaaagagggcataaaaaaattgggttttgttttgatactccatatagcgaagctcaatgtcagaggaaagagggttatttgaaagctttacaagattacgatttacatcatagaagcgaatggatattcggcgaaatgtttaatatcgaggatggctttcgtgtttttcataagataaaggatctaaaggacagaccctcagcaatatttacaggaaatgatcaagtcgccgcagggattattaaacaggcgatgaaaagtggctttaaagttccagaagacttagctgtaattggttttgacaaccaattgatctgccaagtcgttactccgaccataacaacaattgatatccccgtaatagaattaggtcaacaggctgtgttgaaaatcatcgagtccatttcgggtaatgccactttaaacagaagaattattaaactgccaacaaagcttattataagagaatcaacgtaacgatagatttccctttatcattttatatctttatataagaaaaagaggttattcattttaacctctttttcaatcgtaagtcgtcaattatttctttcatttcaccctctggcagcactcacttcaaacctgatccattaacaacgaaatatccgcttatatttcctcatctcgatggtttgcgaattaaaagttcttgaacccttttttcaactaggcactactgccgctgattgagctctttttgtcttttttttcaccatgaagatggtgaagcaggcgataaaacggcggcagcagggcaataaccagaatgacgcgaatgacctgaaccgcaacgacaaaggtggaatcagcatgtaaggtaactgacgtcgtcgccatctctgcaatcccgccgggcgcaaatgccagaacagaagtgatgagcgaaattcctgtcagctcggaaacgatcacggcgctcaaaaacattgctgcgattaaaccgacggacgagacaaacccgacgatgataatacgggtgacgccggcaaacatgcttttatacatcttagagccgatcgttgccccgagaaatacttgtgatacatggttagcttgtgacggccaccatgccgtcatgtcgtgccctgtcaccgcagctccgccaacatgtacaattgctacaccgagcatgctgccgagcagccatggagctggaaattttaaaaatttcgcagctttgcaagctccccaggcagcgagaataagaatgacggtccacaaaacgggagcgagcctaaaatctgtcgttgcagaagaaattgtctctgctgcggcacttgcggtacgatcttgttttgtatagatcagaatgactaaaaacggaatggaaagcaccacgagcagcacacgcatcatttgaacaaggctgactatagcggtattggcgcctacttcctgtgcgatgctcggcatggcggaaagtccgccgggagcggtgccgacaaagctagtcatcatatccgttttgctgaaacgccaaagcacatatcctgacagcatggccagcaggatagacaatatcagcataacgccgactgaaaaccaatggtctttgagaacagatagaacggataaattcagcttttggcccaattcgatgccgaggatcatctgcccgagggcgagccatcgtcggttaattcctttttggtctggtgccatcatcagccatgccggccgtatcatggcgaggcagcaggcgacaatcagtgttccgatcatccatccaattgatattccggttaatgaaagaataaaccccccggctgcactgattgcgataaaccatagatctttgaggagattttcgtctttcttcaatgtaaaacccttcttcctttttcacgtaacactccaattgttcacgtagtgaatgtatttattactatagtatatttttgttgataaagaaattatgaattattttctataagcgattcacttttcttatgaccttgtgttcgagcttttctattgtgtaagtcagagataaacccgctgtcagcagacacacggcaagagcgtaaaaaatcacttctccgccaaatgatgtcaggatcagcccgcctgccagcggtccgattgagcgggatatatcccaatgcagaccatagacagcataaaaccggcccagcaaatgaggcggcgccaatttcgatatgaaggtctggatgtgggttagcccgatgctttcgccaaccgtcattaccgctgccgtcactaaaagcattgtcagggaggttgagcatgcaaaaccggcagccgcaagggagtagcaaatataagtaatgaaaaggatcgttttcattgaaagcttttcggtccctttgacaagaggtacttggagaacacagctgaataaagcttttgctgctgaatagatggtcagcatggacagataatcagaaaacatgtttttgctgaacagcctgtatgttgtttctgattgtgcatataacatgctgatggggagagaaagcagcaaaagaagcaggacaggcctgtatatcataaagctcgcagacattttcggggtaacagctgggtgtagcggctttgtctcaggcagtttcagtgcagcgatcagaaagtagataaacaatgctgcagcatctaatgcgaatatccacacggggttatgattgtacagcagcatccccactagcggtcctgccgtcagacccgctgaatagatcgcattgatgaccgcaaacacttccgaacgtctgctttccggcgtgctttcagcgatttgggcgcgggaagcgggaatgtacaacgatcttccgatgccattcatgacatagagaatagcgaaaacatacgcatgctcagcaaatacaaaccctgtcattgccgctgattgaagaagcaatgcggtcaaaatcgctgtgcgccgcccaatccggtccgccgcctttcctgcagcgagcgtcaggaaaatatcagcaaatggctgaaggctgatgatcagcattggcatcatgatactgccgtttaattgttcatgcagatacagcaccataaaaggtcccatcattgcacctgtcaggcttgtcagcaattcgccgaaaaagcggagccgaacgggagcggtatatctcgattttatagagtgaaaactagtcaacatgtgatcgccgcctttcgctgtttgatatagtagtagtgtatagaaggggcggcggcccaaaaagtgaagaaaagaagagataaaagttccccttttgtcgggaggtgcggggattgaagctgatagagcactacgtggcgcttgtaaaaacaggctgcgccgagtatggacaaatgaacgaaatgacactcactgagattgccgactgtttattttgtacagaaagaaatgcaaagctcattttacataagctggagaacagcaattggattatccgggaaagcggggcggggcgcggccgcaaatctaaaatcgcgtttcttcggaggcctgaggaactgcttcttcaaactgcaaaggaatataccatgtcaggaaagcttaaaaaggcaaaggagctgcttcagcagtatcagtccgcgtttccagggcttcaaaacgaatataacatgtggctatcagaggtattcggatttgtgacggagacaggcgagaatggggcgaaggatgtcctgcggctgttcatcacgcctgaatctgtcagcagtttggatccatgccaaatatttttgcggtctgagggccatttcgtcaaacagatatttgatacactcttcacgtttgattcggatatgcaggagccgaagcctcatttggttcatggatgggaagaggtcggaaaaaaacaatggagattttttcttcgaaaaggtgtgttatttcataatggacagccgctgacatcgcgggacgttgcgtttacatttcagcgctttttggaactggctgacaacccgtataaatggcttctgcacggagtgaaacaagtcttagaaaagggcccttattgtgtggagctcatactcgataagccgaatgcgcttttgccgtatgctctttgtgatgaacggctgtccatactgccggcagaacagggcggcgggaaaaatggaacagggccttttcagatgaatcagcaacatagcgggatgcttgtgcttgaagccaatgagcgctacttcaagggacgcccctatttggatcgcgttgagtttgtgttttctgagcaagccggagagatgaacggttttaccattcaagaaaaacaaacatgtcctgagcagcaaactgtctttgatgagcggcatgttcagtatttgtcgcttaatctgaaaaagaaggggcctcttcagcaccgaagctttagaaaagcgctccggctgctgatttcctctgaacggctcgttcgtgaagcgggagggcaccgaagaattccggttacgtcctttttgcatccgagtccttttgagtgggagggcgtttcgccatctgaattgttgaaaaaaagcggatacgagggcgaaacaatcgtgctttataccttttcggaaacggatcatcgtgaggacgccgaatggattcaaaatatttgcgcccagcacggtatcaggcttacacttcaattctgtgatgctgctgatctgcgacggccggaaatcgtgcagatggcggatatcattcatgacagtgcgacgttttatcaagacagcgagtttggttttctgcatttgctgctgtcggagaacagtttcttgtatcagcatctatctgaaaagctgacacagatttgctcaggaatgacagagcggatgttttccatgcctgaccgctgttcgagaatcaacatcctgcgtgacattgaccggcagatgatacaggagctgaacgcgatcccgctgtatcaaaatgtgctccaggtgacatcaagtaaaaatgtaaaaggcctggtgcttgatgaagagggatggattgatttgtactccgtatggctgtccaaataaaaagagggttcttttttgaaccctcttttttacgctgccatgctgcggcattgttcagcacaggtgaagcaggctttcgcacatgcttggcaatgatcatgatcgtgctttccgcattcagtgccgcatgcttcacaaatatcggcgcaaagtgcacaaatttctttcataaacgggctgtccgtttgcatggctttgaccgccagcgcgcaaatatccgcgcattccctgtcaagccggatgcatccgctgagatgatgctgcacgctttcttccaagcatttagtgaaacaatgattgcaagccttcatgcaatcgatgcaagcctcaatacaagcctcagaatattgctccatggttgattccccctgtatgacagtatatggttttatgtttcacggctgcatttgaaaaaaacaggggagtgtgtttttagctaaggggatatgtacatataccctgaatgggtatatctaacgttccatcagatagtataggaaccagacagcgtgattttgttcatcacgtgctgcgcgcgtaaagacgcctttcgcttttaagtttgacgtttcctcggccgcacgcaagtaaaagtcgacggtttcttgttcatctttaaaagcggcgtccagtcctcttgtgaaattgtccgggcattcttccgtttgtttcggcatgatgtgtttgccggtaattgaaccatacagtgtggaaaattcacggaggtggcgaatctcgtcacgcctgatttcttcaatctgttttctgacctcatcgctgtgggcgagttcggcaagcttgcggtagcattgaatagcactgaattctccgttgatggccttctgcaaattccgaatcaaaacaggatcttccctgtatggcaccggatagggatagtagctgtaatgcaaggggattcaactccattcttaggaattgggcttctgtaaaagtatatgttgggcagggagagatgtgcggagataatcagctttttatatgtgaaaaggccgtttttaccaatagatcagattggtcattttcgtcaacattcgataaaatatatagagataaaaagagaggggtcttctaatttgggagcagagtttttagtaggcaggtccgggagtggaaaaacgaagctgatcatcgacagcattcaggatgaattgcgccgggctccattcgggaagccgatcatttttctagtcccggatcaaatgacgtttttaatggaatacgagcttgctaaaacgccagatatgggcgggatgatacgcgctcaagtattcagtttttcacgattggcctggcgcatcctccagcatacgggaggaatgagcaggccgtttctgacgagcaccggcgtacaaatgctcctgcggaagctcattgaggagcataaacaggagttcaaagtctatcaaaaagcgagtgacaaaagcgggtttaccgcacaggttgagcggatgctgacagagtttaagcgctattgtctggaaccggaggatatccgccggatggcggaaagcggaacggcttccgagtatcgcggagaacgagttttatctgaaaagctccatgacttatcaattctgtatcagcaaatggaaaaaagcctcgcagaccaatatcttcactctgaggattatttgacattgctggcagagcatatcccgcttgcggaagatataaaaggcgcccatatctatgtggatggcttttatcagtttacaccgcaggaattcagggtgttggagcagcttatggttcatgcggagcatatcacgttttcgctcacagcggacaagccgtcatatgagcgggagccgcatgaactggaattgttcagaatgacggggaaaacctattaccgcctgcatcagaaggcgaaggaactgaatttggacattacgtataaagagctgagcgggactgagcggcatacaaagacgccggaattggcgcatctagaggcacagtatgaagcgcgtccggccgttccatacgcagaaaaacaagaagcccttactgtgatgcaggccgcaaacagacgggctgagctggaaggcattgcccgggaaattcacgccctagtcagagagaagggatatcgctataaggatgtagccattcttgcgcgccagccggaagactacaaggatatggtgaaggaagttttcgcagattacgagattccttatttcattgacggaaaagcatctatgctgaaccatccgttaattgaatttatccggtcaagccttgatgttctgaaagggaattggcgttatgaagcggtgtttcgctgcgtgaaaaccgaactgctattcccgctcaatgaaccgaaggccaaagtgagagaacaggtcgatcagctcgaaaattactgtatcgcctatggtattaaaggcgaccgctggacaaagggcgatcggttccaatacaggcgttttgtgtcattggatgatgattttgcacagactgatcaggaaatcgaaatggaaaacatgttgaatgacacccgcgattggattgttccgccgctttttcagcttcaaaaacgcatgaaaaaagcgaagacggttcaagagaaggcggaggcgctctatcgttatttagaagagacggatgtgccgctgaagctggatcaggaaaggcagcgtgctgaggatgacggcagaatcattgaagcgcagcagcatcagcaggcgtgggacgcagtcattcagctgcttgaggagtttgttgaaatgatgggagatgatgagatttctcttgatttgtttcagcaaatgatagaagccggcgcggagtcgcttacattttctctaattccgcctgcgcttgaccaggtgtttgtcggcaatatggatttgtccagaatgtatggcacctcctgcacctttgtgctcggggcaaacgacggcgttctgccggcacgccctgatgaaaatggggtcctgtcggatgatgaccgggaatggctgaaaacgattggggttgagctatcctcaggcggacgggagcgtttgcttgatgagcatttcctcatctacatggcgttttcaagtccgtctgaccggctttacgtatcgtatccgattgctgatgcagaaggaaaaacgcttttgccgtcgatgatcgttaagcggctggaagaactgtttccgcatcataaggagcgcctgttaacaaatgaacctgaacaggtcagcgatgaggaacagctgatgtatgtcgtgaataaaagcgtggcacagtcctttaccgcgagccagctcaggttatggacccgggaatacgacatcagcgacgtctggtggagcacgtacaatgtgctgatgagtgagccggacaggctgcaatcgaaaaagctgttctcaagcctgtttttccggaatgaagtgaagcagcttgaacgcagcgtgtcgagacagctctatggtgaacgcattcagggcagtgtatcgagaatggaaacctttaacgcatgcccgttttcccattttgcgtcacacgggctgcatttgaaggaacggcaattcttcaagcttgaagcaccggatatcggccagctgtttcattccagcttaaagctgatttctgacaggctgcgtgagcaaaagctggattggcgcgatttaacgaaggagcagtgcgagctgttttcctatgatgcggtagaacggctggcaccgaaactgcaaaaggaaattctgctcagctcaaaccggcattattatgtgaaggaaaaactgcaaaaaattgtgacacgtgtgtccggcattttaagcgagcatgcgaaagcgagcggattcgtaccgatcgggcttgaactgggctttggaggaaaagggccgcttccgccgctgacctttcaactgaaaaacggctgtacgatggaactcgtcgggcgaattgaccgtgttgataaggctgaaagctcaaaaggcctgctcctcaggattgtcgattataaatcaagcgacaaaggccttgacttagcggaagtatattacggattggcactgcaaatgctgacgtaccttgatttatcgattacacattcagctgactggctcgggatgagggcgacgcctgccggagtgctgtatttccatattcatgacccgatgattcaatctaatctcccgcttgggcttgacgagattgaacaggagatctttaagaaatttaaaatgaagggcttgctcctcggtgatcaggaagtggttcgcctcatggatacaacccttcaagagggacgttcaaatatcataaacgccggcttgaaaaaagacggatctcttagatcagactcggctgcagtcggtgaaaaggaatttgatcttttgacaaagcatgtgcgccgcaccttccaggaagctggcgaacaaatcaccgacgggcgcgtatccattgagccgtacaaaatgaagaacaagacgccgtgcacatactgtgcgttcaaatcagtatgccaatttgatgaatcactggaagaaaacgagtatcgcccattaaaggctgaaaaggacaagacaatacttgagtggataaaaaaggaggcggatggcaatgaacattcctaaaccggcagacagcacatggacagatgaccaatggaatgccattgtttcaaccggccaggatattcttgtggcagcggctgcgggctctggtaaaaccgctgtgctcgttgaacgaatgattcggaaaatcaccgcggaggaaaacccaatagatgtagaccgtcttctcgttgtgacatttacaaacgcctcagcggcagagatgaagcaccgaatcgcagaagccttggaaaaagagcttgtacagcgccccggctcgctgcatatcagacgccagctgtctcttttaaaccgggccagcatttcgacgcttcattccttttgcctgcaagtgctgaagaaatattactacttgatcgatcttgatccgggctttaggatagctgatcagacggaaggcgagctgctcggtgatgaagtgcttgacgagctgtttgaagacgaatatgcaaagggtgaaaaggcattttttgagcttgttgaccgctatacgacagaccggcacgatctggatctgcaatttctcgttaaacaggtgtacgagtattcccgatcccatcccaaccccgaggcgtggctggaaagctttgttcatttgtatgatgtatcagaaaagagcgccatcgaggagctgccgttttatcaatatgtcaaagaagatattgcaatggtgcttaacggggcgaaggaaaagctcttgcgcgcgcttgagctgacgaaagcgccgggcggcccggcgccgcgtgctgacaattttcttgatgatcttgcgcagattgatgaactgattcagcatcaggacgatttcagtgaactatataagcgggtgcccgccgtctcttttaagcgtgccaaagcagtaaaaggggatgagttcgatccagcgctccttgatgaggcgacagatttgagaaacggcgcaaaaaaactgcttgaaaagctcaaaaccgactacttcacgcgaagtcctgaacagcacttgaaaagcctagccgagatgaagcctgtcattgaaacgctcgtacagcttgtcatcagctatggaaaacggttcgaagccgcgaagcaggaaaaatcaatcattgatttttctgatttggagcattactgtttagcgattttgacagctgagaatgacaaaggtgaacgtgagccgagcgaggctgcgaggttttatcaggaacagtttcatgaggtgctcgttgacgaatatcaggataccaacctcgtgcaggaatcgattctgcagctcgtcacaagcgggccggaggagactggtaacctgtttatggtaggagatgtcaaacagtcgatttatcgattcaggcttgccgagccgcttcttttcctctctaaatacaaacggtttacagagagcggagaaggcacggggcggaaaatcgatttaaataaaaatttccgaagccgggctgatattttagacagcacaaactttttatttaaacagctgatgggcggcaaaatcggtgaggtcgattatgacgagcaggctgagctgaagcttggtgcagcgtatccggacaatgacgagacggaaacagagctgctgctgatcgacaacgcagaagatacggatgcaagcgaggaagcagaagagcttgaaacggtgcagtttgaggcaaaagccatcgctaaggaaattcgcaagctgatttcatcgccatttaaggtgtatgacggaaaaaagaaaacacatcgcaatattcagtaccgagatatcgtgattttgctccgttcgatgccgtgggctccgcaaatcatggaggagctgagagcacatggcataccggtttacgccaatttaacgtcaggctattttgaagcggtcgaagtcgccgtcgcgctttctgtgctgaaggtgattgataatccgtatcaggatataccgcttgcctctgtgctgcgctcaccgattgtcggagcagatgaaaacgagctgtctttgatccggcttgaaaataaaaaagcgccgtactatgaggcgatgaaagactacctggctgctggtgaccggaacgatgagctttatcaaaagctaaatacgttttacggacatctgcaaaaatggcgcgcgttttcgaaaaaccactcagtatctgagctgatttgggaagtgtaccgcgacaccaaatatatggattatgtcggcggcatgccgggcggaaaacagcgccaggccaatttgcgtgttctttatgacagggcgcgtcaatatgaatcaacggcatttcgcggcttgttccgtttcctgcggtttatcgaacgcatgcaggagcggggcgatgatcttggtacggcgagagcgctcagcgagcaggaggatgttgtccgcttaatgacgatccacagcagcaaagggctcgaatttccagtcgtgtttgcagcaggtctcggccggaatttcaacatgatggatttaaataaatcgtacctgctggataaggagctcggatttggcacgaagtatattcatccgcaattacgcatcagctatccgacacttccgctcattgcgatgaagaaaaaaatgcgcagggagctgctgtcagaggaattgcgtgtgctctatgttgcattaacgagagcgaaggaaaagctgtttctgattggctcatgtaaggatcatcagaaacagcttgcaaaatggcaggcatccgcgtcccaaactgattggcttctgccggaatttgaccgctatcaggcgaaaacgtatctagatttcatcggcccggctcttgccaggcacagagacttgggggatttggctggtgtgccagcacacgctgacatctcagatcacccggctcgttttgccgttcaaatgatccattcctatgatttgcttgatgatgatctggaagaaagaatggaagaaaaaagcgagcgcctagaagcgatccgccgaggtgaaccagttcccggctcgtttgcgtttgatgaaaaagcccgcgagcagctgagctggacatacccgcatcacgaggtgacgcaaattcggacaaagcaatcggtttctgagatcaaaagaaaaagagagtacgaggatgaatacagcggcagggcccctgtaaaaccggctgatggaagcattctgtacagacgtcccgcttttatgatgaaaaaaggcctgacagcggcagagaaagggactgccatgcatacggttatgcagcatatcccgctgtcacatgtgccgtcgatagaagaagctgagcagacggttcacaggctttatgaaaaagagcttctcactgaagaacaaaaagacgctattgatatagaagaaatcgtgcaatttttccatacggaaatcggcggacagctgatcggcgcaaagtggaaggacagggaaataccattcagcttagcgcttccggccaaggagatctatcctgatgcacaggaggcagatgagccgcttttagtgcagggtatcattgactgtctctatgaaactgaggacggattatatctattggattataagtcggaccggattgagggcaaattccagcatggatttgaaggagtggccccgatcttgaagaaacgatatgaaacgcaaattcagctgtacacgaaggcagtggagcaaattgcaaaaacaaaggtaaagggatgtgcgctttatttctttgacggagggcacattctgacattatagcgagatccataagctccggaatttcaggcggagcgggtctcgttttctatataaaagagaggtgaaagcatttgcggattttacatacggctgactggcatcttggaaaaacgcttgaaggaagaagcaggctgagtgaacaggccgatgtgctggatgaaatgaatacgattgtaaaggatgagcagatcgatgccattgtaatggcaggggatgcatttgacaccgtaaacccgccagctttagccgagcagctgttttatgaaagcctgtctgcgcttagcgacagaggaaagcgcccgatcgtagtcattgccggaaaccacgataatcctgaccgtttgtccgccgcttcaccgctgacacatgaaaacggcattcatttaatcggttatccgacaacagagccgattcatattgaagtgccttcagcaggagagcttttggcggttggagcactggcgtacccatctgaagcgcggttaaatgaagtgctatccgatacgtttgatgaaaagctgctccgtgatcactatgatgtgaaaatcaggcaggcgtttgagcatatgacaagccggttccggaacgatgcagtgaagattgccgccagccatatttatgtggcaggcggaaaccaaaccgattcagagcggccgattgaagtcggcggtgcatacacggtggctgctgaaagcctgccggcagatgctgcttacgttgcgctcggccatttgcatcgaccgcaaacgatcaagcgggcgcggacgcttgcgcgttattcaggatctccgctcgcctacagcttttctgaagcgggctacgctaaatcagtgacgattgtggacgcaaagcctggggaagaggccacttggcaagaggtgttattatcaagcggcaagccacttgtgaagtggaaagcggcaaatggattgagtgaggtgtacagctggctggatgaaggcagagatcagaatgcttggattgacctggaaatccgtgtcgcggaccagctgtcacttgaagagattcacaggctgcggaaggcgcatccgggctttatccatatcaggccggtttttgaagaacagaacaaagaccgggaacggatcgaggttaaacatgtctcaatcgaggaccgctttaagaaattttatgaaaaacaaactggcggtgcggtgccggatgaagaaatggtgaagctgtttttagagcttgcatcaggcgttgaagaggaggatgcgaaatgaagccgatcgccttaagcattaaggggctccacagctttagagaggagcagacgatagattttgaaggcctttccggtgctggtgttttcggcattttcggcccgacaggaagcggtaaatcctctattctcgacgcaatgacgcttgctttatacggaaaggtggaacgggcggcgaataatacgcacggtatcttaaaccaggcggaagatacgctgtctgtttcctttacctttgcgcttcagacgaatcaccaaatctcatacaaagtcgagcgtgtgtttaagagaacggatgaaatgaaggtaaaaacggcactttgccgcttcatcgaaatcaaggatgagcatacggtgctggctgataaagccagcgaagtgaataaaagagttgaggagctcttagggctgacgatcgacgattttacgagagcggtggtgctgccccaagggaaatttgctgaatttctgtctttaaaaggggcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtctcggtgaggcgagctcagaggcagtggagcaggctgaaaaggctctcgaacaagctgaagcccggctggaagcgatgaggaagaaccgtgatcaggcgaaggagcggtttacagagcatcaggagatatggaatgtccaaaaggaaaaatccgcttatgaagaagaggaaaaacgtctcgcagaagaacagccgcatatagacagcatgcaaaaacgcctgctggaagcagaaacagcagcagctcttaagccctatgcggaccggtacgcagaagcgatccagcatgaggaacaagctgaaaaggaacaaacgctagcccaaaaggatttagcagaccggacagctttctttcagcaaaaacatgacgagtatgaagcgtggcgccagcataaaagcgagaaagagcctgagcttttaactgagcaggaacagctttcacgcttgcaggaaatcgaaatcaaactgagtgaggccaagcaagaggaagagcgcaaaaagactgaactccagcagaaagaagaggctcttcaatctgtcatgaatgaattggagacggtaacagaccgcctgacacgagggcaaaacagacagacagaattgaaacagcagctcaaatccctgcaggtgacatccaatgagcgaaaaagctgccatcaggccgcagaaatggcattgcgcatcagacaaaccgaggagcaaatcaaaaaagagaaaaaacgaagtgaagaattgaacctcgtgctgcagaagatgaatgaagagaagaatacactcgttcaaaagacggaagcggaagaaaacaacatcattcaggcatatgaggctgtacaaactgtgtaccatttggtgtgcgaaacggaacgctcattaacacgtatgacggaagaggctagaaagagtcaacacacgcttcacttacagcgtgaaaaagcaagggtggcactgctgacaaaagagttagcccaaaagctgactgccggaaagccttgcccggtatgcggttcaaccgatcatgatccatctgcctcagtacatgaaacgtatgaagccgacagccatcttgaagaggacatcaaacggacagatgtgttattgacggaagctgcagctctcagccaggagattctttcagccaaaattacgcttgaagaacagtccgcgcgctttattgaacagtgtccgtttttgcagacaattcaagcacagaaccttgaagcggcagcttcctttgaacatcagccggtgtatgaagcatttgaaactgccaaattcgaatggaaacgaatcaagcaggacattctttctgttaagacacgaatggcacaaatgatcggcgcctatcaggaatctttaaaaaaggccgagcagcttaatgaaaaaatcggttttgaaaaaagagaggctgaccgtattgaaagcattatcactgagctccaatcctcaatggacagcagtctgaacatgtttaaagaagcatttcagaatcaatctgtggacgaagcagaaaaatggcagcaagctattgaagaaaaggaccgggctgcagaagaatgtgaaaaacgaattgagaagagtattgcgtttcttgctgagcatgaagcacaaaaggaaaaactgcgggaatcgggacaccggcttgaacgagaaaagctggagcttcattatgcggctgaacgcatcaagagcgtgatagctgattatgagcacgaactcggagattatgcaaaaggagattcgattcaaatcaaactccgctctgtccagcaggatctaaagctgttaaaggaaaaagaacaatctttatatgaagaactgcaaagcgcccaaatgaagctcaaccaggcgaaaagccgcgcttctgcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaagaagctgaggacgcatttggcgctgctatagaggaaaaaggcgcggctgcaaaagcactggctgtcattcgcgaccatcataaacggtttaatgaaattgaagctgaactgaaaaaatggcagacgcatatcgacaggctggacaagctgcaagctgtgtttaaaggcaataccttcgtcgaatttttagctgaggagcagcttgaaagcgttgcgagggacgcctcagcaagactcagtatgctgacaagacagcgctatgccatcgaagtagattcagaaggcggcttcgtgatgcgggatgacgcgaatggaggcgtacgacgcccggtttccagtttgtctggaggagagaccttcctcacctcgctttcacttgctcttgcgctgtctgcgcagattcagcttcggggggaatacccgcttcagttctttttcttagacgaaggcttcggcacactggatcaagatctgcttgatacggttgtaacggctttagaaaaacttcagtcagacaatctggctgtcggtgtcatcagccatgtacaggaactgcgtgcacggcttccgaaaaagctgatcgtccatccggctgaaccgagcggccgcggtacgcgggtatcacttgagttgatgtaagggaggagcggatatggcaaagcagactgccggaatatgtgagctgtgcggccggagcaatgtccagctgacagagcatcatctcacaccgaaagaggaaggcggaacgtttttgccgacagcgatgctctgtattccttgtcataaacagattcatgccttatataccaatcaagagctcgctgtacgtttaaatggaatggttgaactcagaagcgatccagagcttgcccggtttgtcaaatggatcagaaaacagccgcctgagaagctgatcaaaacaaagaaatcaaatgaacgaaaaaagaaaaaatgactaaaaagcagccctctctttgcagagcggctgcttttatccgtttccaaccatatcctgatcgttgacatcggggtctatataatttgtcgcgttgactgcattatttaatagaaggaaatctcccgtgtttcctgctcccgaaccgagcgcagattttgaagagcttttcggagaaaggtaaaaggaatcaccaaagtttacgactccgcccgatatggaattgatagctataggcccgacaattgctggcataaacgacaccctttatcgaagtctctgtttattatatgttcttggcgggcgattgtgagcgcggagactgaatctgtctgatatgtttgattctcgcatcaccgcggataagcgaagctgaaccagcatgtaaaacagaagaggcggacaccccttgaattttgatgctgcgaacataaatagccggcacctcgtggcaaaatgcgctttgtacacctgtttcgggaatcggcttcactgcctgctgctgaaagatttggtactcctttttgttaaatgagccttcattatggtaaaacgtggaccgagaacgctgaacagcaaatacttttacactcatatcgatttcatttgtgtcgccaacttgaaacacacttgcgatcccgagggaattacacttaactagtctgatgcgtgatatgcgtttaagcattattctggcgcaatcggagcaaacggcccgataataagagattcaggcggtgtatcaaaaatagaagacaggtagatggattcagtgtctccgatgtggaaaacggaggaactggacacaccgttcatccggatgtccccgacttccaagctgcggttgatgactgtaaagatcatgcttgctcatctcctttcatttctgatggaatatgctccagaaagtgttctacagcgcggatgacatcacgcttcacatgctcagcgatatgttctgcatattgtgcaggcggtgtattttcttcttttttgatatgggacatataatagtgaatccggctgtccatttgttttctgatgtcttcaataacatgatgtctgtttgtatcgtcaagtctgctgtcatattggttttcaagctgttccaaaatatctgggatttcttcggttaagtacatgtcgacattctggcggatctgctgcatgagctgagcgctctcttcctgctgcatcatcccgatttgcggtgtcgactggctgacttcaaagttttggacgctgttcgggtcagtcggatttaagccgatattcaaagtcccgtcgagcctttcaattttcagctgatcaaatttatactccacacgctcaatggtagtggccggccgctgtttcatcgtattcatttcagtttgaatctctttcagctgacgttcgagctgctgaatgtgaatcgcctgctgctgaacgaaggaattcaagttttgcaggtaagaggaaacagattgatcatacatgttctttcacctctttcatatgattaacggccaggaggctggagcgggaccaatgaacctgtgtcgggctcctgcagctggagcggttgccctgagccagaaacttctggtgccggttctacataactccctgtattatacaaatttgacagagacttgattgatccggcgctcccgatttgcagaatggaggagttgctgattgattccagccggagatagttgatttgaatggtttgattaatatagaagttcatgagcctcactccttttacgcattggccacgatcggctgatcaaccgcatcattgtcatacacattcgtcgcgttttgataattcatcaccttgaggctgtcgccggtattaaagctgccggcaccggcaaacgttctgacctgagcctgaggagaaatcgtaatgcagtccccgatgtgaacgactccgctcgtaccaatcgcattaattttaaacgctccgacaatggccggcatacgagcacatcctttgttgaaaaattaaaaaaagacaggtaaagtgaaatgacaattctgatttcaattgggctattcacgatagcttatgacaaacgcacatatgtgtgagagaaattttaaggggacatatcggctctttgtgaaagcgttttattttttcgggccgttatgtttaaacatggcaaaagaggatgttgggtataaattgagcggaaatgcggcgaaggatgccgctatccgcctatggtgatttttgtttatttctttggtgtttttgcgtgtagaatgctttttggagtatgtcgtgctgcggtattcgatttttgggcgggcacattctcgccctgaggtatatctcagaagtgctgagcaaaaatcggagttacatgtggtgtattctaattgttatagaaaatgatttacatacgggagttttcaagatatctcccaaaaatcatttcttctttaatccgggtattcagcaggatatccagctcttggctgcattgaatcgtttcttttgaattcatgccgtatttttgtgcggtttcaattagtgtgatcctcatttcttcaattttactgttcattacgctatctccaattctagattttattttgatataaatacaggatatcgttagtataacctattttggctcaaaaggttgcctttcgtcaatttgactaaaaaagcgacaatttttgctgcggccttttttaatggagaaaggactaaagtcttgctaagtgtgcttgcaaaaagtcctgccgttcctcaatttctctaagtatgttggtctgctccttttcgatctgaaaggggctttttttgataaaaggatcatcagcagcactttgacaaatgtcaaggtgccattcgttgatgagaggagataatcgttcaatagtaaacgaccgcttcagcacgtttttcattaaggtgtgatattgcgacctgaaggcgggaatggatagaagccttgacgaaagcgtctttccttttgtcagaagcgggtcttcttcataccattcttgtacggcaagcgatcttgtctccatcggggaaacgtaaagccgaccggattcgtttaaacaaattgtgcagtaaaagccttgattggtgcaggcgttgccgatcagccacaaaaaaaacagcttgacatccagatacaatttaatcctttcagccaattcgtcatctccggctgtgcggatcagtatgaaaaattcatgtaagaatgccgaggaatcattgttaaaaagggacaatggaacccttggatcggccgtcttcactccgtaactccttttaccggctggttgatggttcttgatgttcaaataaatgccttcaggctggccattgatggtcagaaagctgtacgaggcaacgggagcaggtacgccgatctggtcaaaaaaacaataggcgagtctgcgccgcatcagggacggatcatcctgttctgcattcaaaaaaagtgtcctttcaccaagcagagacttttcccagctgatttcataggatgccttttccgctctgtcacgctgtgtgagaagaatgggagaaacagatcgatctgttacgaaaagccccttggcagtacctttccttttcagctgctcccgatgaaaaaataaatgcacgcgctccatattctttcctccttctcaaaacgacatttgtatgatatgtagagcaagcccgtcctgaaacgaaatgaaaacggaattgagaaaaagggatttcagcattcgacagagaatacatgaaggagcattctgatttaaaagatgatggaggaataacatgaaatttgcgacaggggaactttacaaccgaatgtttgtcggcctgatcattgacgatgagaaaattatggatttgcagaaggctgaaaaaaaactgtttgaacttgagacgattccgggatcgctgattgaatgtatcgcagaaggggataaattcgttgcacatgcaaggcagctggccgagtgggcaaagaaaccgaatgatgagctgggatcatttatgtattcattatctgaggtgaagctccatgcacccattccgaagccatcaaaaaatatcatctgcatcggcaaaaactaccgggatcacgcgattgaaatggggagcgaggctgatattccggagcatccgatggtatttacaaaatcgccggtaacggttacggggcatggtgatatcgtaaagagccatgaagaggttacctctcagcttgattatgagggagaacttgctgtcgtgatcggaaaaagcgggactcgcatttcaaaagaagatgcatatgaccatgttttcggatatacgattgtgaatgatatcacggcgcgtgatctgcaaaaaaggcataagcagttttttatcggaaaaagcttagatacgacatgtccgatggggcccgtgcttgtacataaatcatctattcaggagccagagcgcctcaaggttgaaacaagagtcaacggcgagctgcgccaatccggttcggcaagcgatatgatcttttccattccggaattaattgaaaccctctcaaaggggatgacgcttgaagcgggcgacattattgccaccggtacgccgtctggtgtcggcaaggggtttacgcctccaaaattcttgcggtcaggtgacaaaattgatattacaattgacccgatcggaacgctgtcaaaccaaattggctgaataaaactcgagggcggacccggacccgcccgttttttctgataatcatctttgtggcagaggacaagttcatggtactataagtggggtaatttatctgatagggggaacatgtatgacacacctacatattacgacatgggtggtagcgctgattctgcttttcgtcagctactcgctgtattcgtcaggaagtgcgaagggcgcaaaaatcactcatatgattctgcggttattctatatccttattattttgacaggagctgagctgtttgtccgtttcgccaactggaacggagaatacgccggcaaaatgattctgggcattatcaccatcggcctgatggaaatgctcctcatccgcaagaaaaaagaaaaatcaacaggaggcctgtgggtcggcttcgtcattgtccttttgctgacagtgctgctcggtctgcatttgccaattggttttcaattgttttaatagaaaaacctatgaacccagctctttgatagagttggttttttttatatttatcccctcatattccaaatcatttaaaataaccttaaaattccctgtaagcggtatctcgtcctatgaaattatgataccttcaaggagattcattattttgcaggagggataacatgaaacgcagaaaattcagctcggttgtggcggcagtgcttatttttgcactgattttcagccttttttctccgggaaccaaagctgcagcggccggcgcgatcgatcaggcggctgctctggaaaacggcaaagagcagacaggcgccatgaaggagccggaacaggtgaaatggtacaaagtgaccccgggagcaacggatattcagaaaaactcacatatggcactgaccgtaaagagtgattcagtactgaatgtatctgtatatccaagtaaggaaaaagcgcttaaagatgagacgtttgagatgtaccgttctttcacagcggaggatggaaaaagcgaagtcatctttccatacgcgtggagcggcccttactatgtaaaagttgaatacctcggagaagaagagccagaggacgacggaacggcagaagcagctgcagaagccaagtatacgattgggtataaaggcaccaaaaaacagccgtcagatttagaagaggaagaagcttgtccggttgaaatgagtgtcgatcagaagaaatcaggaaaaggcatactggataagctgagagcgattcgtgatgagcagctgagccaaacagcagaaggcaaagaactgacaagcctttattacaaagcagcaccgtttatcgttgcaaaactcgcactcaataaaacagcaagaaatgaaatctatcaggatcttgtgacattaaagccgttatttgacgatgtgtcagaaaacggagcatcatcttcgtataaggtaactgaaaaagatcaaaaagcgatcaaccggctatatgataaagctttgcaatcagtcccgtctttccttaaagaggagataaagaaacaagcggaccgactaaatatgaagcagctgcaaggcaaaacagccggagccattttaacagaaaacaatattgcagcaaaaagtgaagttcagacaacaaaggttattttcaaggtgaaggacaataaaagcctctcatccgtacataatgaaatgaagggcttttctgcaagcgcgcaatcgaaaaaagacatatccaatgtgaaaaaggcaaagaaactgtttgacaatctgtattcatttgaacttccgaaagacgagaaacagaacggcgcatatacggcaagcgccaaaagggtcaaaagcgctgctgcgacactatccaagatgtccaatgtagagtttgcggaacccgtacaggaatacaaaagcctggcaaacgatattcagtacccttatcaatggccgcttaaaaacaacggtgaaaacggcggtgtcaaaaatgcggatgtgaaatatgagcctgccaacacattgctgtccaaacgcaagcttaacgatacactcattgcagtagtagacacaggcgtagacagcacgcttgctgatttaaaaggaaaagtaagaacagatctcggacacaattttgtcggacggaataacaatgcaatggatgatcaggggcatgggacgcatgtcgcaggcattattgcggcccaaagcgataacggctattcaatgactggattgaatgccaaagcaaaaatcatccctgtaaaagtgcttgattccgcaggttccggagatactgaacaaattgctctcggcatcaaatatgctgctgacaaaggagcaaaggtgattaatttaagtttaggcggaggctacagccgcgtgcttgaatttgctttgaagtacgcagctgacaaaaatgtcttgattgccgcagccagcgggaatgatggagaaaatgccttatcttatcctgcatcttctaaatatgtgatgtcagtcggcgcaacgaaccgcatggatatgaccgctgatttctctaactatggaaaaggtctggacatctctgctccagggtctgatatcccgagcttagtgccgaacggaaatgtcacgtacatgagcggaacgtctatggcgacgccgtatgctgccgctgctgcaggattgctgtttgctcaaaatcctaagctgaaaagaacagaagttgaggatatgttgaaaaagacggcagatgatatttcctttgaaagtgtcgatggcggagaagaagagttgtatgacgattatggcgatccgattgaaattccgaagacacctggtgtagactggcattcaggctacgggcggctgaacgtcatgaaggctgtcagcgcagctgatttacagcttaaggtcaacaagctggaaagcactcaaacagctgtcagaggaaacgcgaaggaaggcacacttatcgaggtgatgaacggcaaaaagaaactcggcagcgccaaagccggaaaagacaatgcgttcaaggttaatatcgcgactcaaaaacaggatcaagtactgtatgtgaaagcaacaaaaggcgatgcgaaaacatcgtataaagttgtcgtcgtcaaaggaaaaccttccggcacaccgaaagtaaacgcggtgaaaacgaaggatacggcagtaaaagggaaggcaaacagtaaagcgatgatcagagtgaaaaacaaatcaaagaaagtcattgcttctgccaaagctgacgcaaaaggaacgttttcggtgaaaatcaaaaaacaaaaagccggaacggtgctgtacgtcacggctgcggatacagataaaaaagaaagcaaggaagcaaaagttgttgttgaaaagtaaccaaaaagcggtgctcgatgcaccgcttttttatttgcgcccccgttggactgctgaatacataatggatcgctttccgtttgaagccgtccattcaaaacggtctcctgtcccttcgttgctgtagtgatgctgcatcgcgcattgtgcggtgtcatttgaaaagtgataaaaggacacaccctgccccgccgaagtattcgaaaagactcctttattataagaaaagacgcaatcgaataccgataagccgaagctgtgcaagtgctgcagaaatgcgagaaaggtttcgtcgtcaagcgaatccaaaagcgccatgagcggccgcttgactgatttctcatagcggatgcgttctcccccggaaagggagatgttttcttcaccgcatgccagaaccaattgatcctggaagccggcttgctcccactttcctttatgatggacccagattgggctgtgttggagagtgtccgccaaaagtatatcaccttctccgttttcgattaaacagatgccgtcttcgatgaggatggtgccgtattcccattttcgttcctctgtatatatcaattgtttccgtttcatgcatgctgtctcctttttcttcattcctctcttttctttccaattcaagcctgtcccatacaactcttttatggacaaatcaactatctgcctatagatgcataaacttactaaggtgctgaaagaaacgaaattgttacgacagaaacgggattggagctgatatcacatgtgtggaattacgggttgggtcgattttaaaaagcagctcgtccaggaaaaacaaacgatggacagaatgacagacactctttccaaacgagggcctgatgattcaaacgtttggggggagcaccatgttttattcggacataaaagacttgcggttgttgatattgaaggcggacgccagccgatggcgtgtacctataaaggggatacgtacaccattatttacaatggcgagctttataacacggaagatttgcgcaaagaattgcgggcgcggggccatcaattcgagcgtacgtcagataccgaggtgcttctgcacagctacatcgaatggcaggaagactgtgtcgaccatctcaatggcatattcgctttcgctgtgtgggatgaaaagcgtaatttgctgtttgccgcgagagaccgtctcggcgtaaagccgtttttttacacgaaggaaggctcttcatttctcttcgggtcggaaatcaaagcaatcctcgcgcaccctgatataaaagcgcgagtggacagaacgggactttctgaaattttcggtcttggaccgtccagaaccccgggcactggcatatttaaaggcataaaagaaatccgcccggctcacgcgctgacattttccaaagacggacttaatatttggcgttattggaatgttgaaagcgaaaaacatacggacagttttgatgacacggttgccaatgtcagatcgttatttcaggacgcggtgacgcggcagcttgtgtcggatgtgcctgtttgtacgttcctatcaggcggtctggactcaagcgcaattacagcgattgcggcgggccattttgaaaaggaaggaaaagcaccgcttcatacttattcgattgattacgaagagaacgataaattttttcaagcaagcgcatttcagccgaatgatgacggaccatggattgaaaaaatgacagagactttcggcacgacgcaccacaaatgcgtcatcagccaaaaagatctcgttgatcatttggaggaagctgtactggtcaaagacttgccgggaatggcggatgtcgactcatccctgctgtggttttgccgggaaatcaaaaaggactttgtcgtcagcctatcgggagagtgcgcggatgagattttcggcgggtacccgtggttccatacggcagatgttgagtctggctttccatggatgagatcaacggaggagcggatcaagctgctttctgactcatggcagaaaaaattgaatctgaaagaatacgtaaatgccaaatatgaagaaaccttggcagaaacgccattattagatggtgaaacgggtgtggataaagcaagaagacagctgttctatttaaatatgctttggtttatgacgaaccttttggatcggaaggatcgcatgagcatgggggcgagcctggaagtgcgggtgccgttcgccgatcaccggcttgtggaatatgtttggaatattccgtgggaaatgaaaatgcatgataatcgggaaaaaggcattttacgcaaagcgcttgaaggtattttgcctgatgacattctgtatcgcaaaaaaagcccgtatccgaaaacacatcatccggaatatacaaaaggcgtcagcgaatggctgaaaacgatcagaagccaaaaggactccgtgctccataccttgctggacagaaaacaattagatcagcttttagaaacggaaggctcctccttcaaggtgccgtggttcgggcagctcatgaaggggcctcagctgatcgcccatcttgctcaaattcatacatggtttgaagcgtatcgcattgatattgacgagaggtaggttcaatgcaaatgtgattaaaatccagagatgtatagatttaaataagaaggatagatgagcagggaaatatatgctctatctatccttttttgtacaacgcactatcgaattgcccccgcattccttcaataagaatgaataggttttaatgttctgccgataaaactagctgataccgggcttaactttaattccctagcccatacagaaagttgaccaatatggtgaatttcgtgagcgatgatatggtgtaatatttcatctcgcgtatataaaacacctgtctcccaaggaacgcttacaagttcatcttttatttgatctgaatgtgtttgtaaaacatcaattatttcagttcggaatgtatttgagagagatttcactttattgagtgtttgataatcagcgaactgaacagcgatatcttcttttccttggatagcacgaatccaactatattccacatcaataatatgaaaaagggtatataaaatattctctactccgccaagacggtttttaagtaattcttcagtggttagttgatgacaccaagtaaaccattgatctctaacttgccagttatattcaaaaaattttatcactgaactcactccaatactatcatgtatcataacaattagcccttttttccgtgattcctctattattgaagtgatgattgagaaatgtttacattctacctgttgtatggcattaaaaataataatgtatatctcgtcgatgatgctgtacgtcttgttacttttacaaagtaagaatcggcattttcttcatatacaattaggaaaaaacatactagacttgaagaagcagtgatacataggagtgagaaaaatgaaagagataaaagaagcttaccagcaatgcggacagattgttggcgaatacgcgccagcctgtttcaaagcattatcatatctcccgctaaagcaaagacaagcctcttgggcagtattgtcgttttgccacacggtggccagtgcagacgaaaaggtattgcccgcatttgaagctaaagctgatcatgtttaccaaaggacaaataacggtaatcaacatctatggaaggcttttgatcatgcgtatcggacctttacattggaaagcgaaccttttcgggagtttattgccgcacaaaaagaagacgccaagccgtatgatgaccttgatgaactgctcatgtacgcatatcggacgggcggttctgccggattgatgctgctgccgatactgacacgccgaaaacaagatctgctcaaacaagcagccgtctctctaggcttggccatacagctggttcgcttcttaagtgatcttggcacagatcagcaaaaaaaccgcattccccgtcaggtaatgcagcaattcggctatacagaggctgatctccaaaaaggcaccgtaaataaagcgttcacaatgacgtgggagtatatcgcttttgaagcagaagcctaccttgaagagtgtcaggatgccttgccgctatttccgcagtattctcaaaaaacggtgaaagccgctcttcatttgcaccgggctgttttagaaaaaatccgggcaaagcagcacgatgtatttcaacatcacttcgctcttacagagaccgaagtgaagcagattctgtctgatatctaaaaaacacccggccttgattgagccgggtgttacgccatacctttttgtatccagatacgtgagcgccatcttctgtacattaagattccccggacccattcatccgcgataaaagaaatccaaatgccggcaagaccgaaaccgaggtggatgccgaaaagataagcaagcgggaggccgatgccccacattgaaatcattgccatgtaaaccgggaatttcgcatcccccgcagcccgcagagagttaatgataatgacattaaacgagcggcctggttcaagaataatggtcatggcaatcaataggcttgcagttgctataatgtcagggctttgtgtgaagagtccgatcaggtcttttgaaaagattgtcatcaaaacagaggtagccgcagcaattccgagtgcccaatataagctcttcatgcagcgctcataagcggcatcaaattgtttgccgccgatataacggccgattaagatttgtgtaccctggctgatcgcagtgccgaacagcaaaataaacatcgtaatattttgcgtatacacttttgttgtcaacgcctgcgcgcccatgatggcgataaaatacgtgacaatcatttgcgaaaggttgtatgaaagctgctctcccgcagaaggaatgccgattttcagcagcttgcgcaaatgctctttatgcatatgaaagacttttttcagcgacatcttcagctggatgcgtttgttgacaatcacaatcatcgcgattaatccgatgacgcgggcgatagatgtggacatggccacaccggcaacgccgagaacaggaaagccgaacaaaccgaaaatcacaacaaagtttccggcaatgtttaaaatgttcatgccgatagtgacaaacattgtatcttttgtgtagccgtagctttttaagatcgcgctgaatgtcatgattaaagcctgaataaaggacagacctccgacaacttgtaaaaagactttcgcatcaggcatcagtgcgtttgataatcccatcatatgaagcagagggacagccgcgaaaaagacgacggcgctgatggccaggctgatgaagaagttggcgccgattgacacataagcgacttccatggcttctttcttttgccgtgagcctagaaattgtgaaatgataacggtcgttcctgttgcgataaagctgaacatcacgataattaaatttaaaatctggttgctgacgccgactgctgccacgctgttatccgagtattggctgagcatcagtgtatcggcattacccataaacatatataatgagacctcaataaagatcggccaagtaagcgaaaataatgagaacgttttgtcagcgggttttttcaaagcagttgatttgaagacagcttgtttcatagtgtctaacccctttcgtaaataaaatcaacgttttaaagtgtacctccatttccttataataaaaagggatagaaacgatacttcttgtaaaaatccgacttaaaaaggaggatgattcaaatgcctcgcatcctgtttacagtcccgccttttccggtatttatcgcagctggggaaggagtttttaaaaaaggagaaacccatgtgaaacgtgtattctccgtgtttgatctgatatatgtcaaacagggaactttatatataacggaaaatgaaacatcgttttctgttgaaggcggcgagtacatcttgctttctcccggtcttgaacactacgggacgaagggcagtgatgaagcaacctcctactattggcttcacttcgatgaacatcgatatgaatttacggcaaagggaggcagcaactggtctgagcttcagcaggaaaaagggagcttcgaagagccggcccgctacggattggccttgccgagaaaaggcaaggtgcagcgcccgcagtttatggcgcagcagtttgaaaagctgatcgattactctgcggaaaactctgatttgccgctcagaaagcaaatcttatttgaggagctgatgttgcatcttcaaaaagaagcgttccaaataccgtctgcgaaagagcgggtagcctgggaggcggcccggtatttacaggagcactataaggaaaagacgacaatcaaggatctgtcgctcgcccttcactatcatcaggattatgtgagccgctgcatgcagcaggtgctcggcgtaactccggcacaatacacgaaccgggtgagaatgacggaagcgaagcgtcttttatcctctacaaatgataaaatgggcgttattgcggaaacggtcggaatggaagatccgacatacttttcaaaactctttaagcagatagaaggcatttcaccaattgaataccggaaaattgtcagccggaaagttcaataaccagacgagggatgaacatgaaaacaacaatttacgatgtggcaaaggcggcgggtgtctcgatcacaactgtgtcccgtgtgataaacaatacggggagaatcagcgataaaacacggcagaaggtcatgaatgtcatgaatgaaatggcatacacgcccaatgtccacgccgcggcgttaacgggaaaacgaacgaatatgattgctctcgtggcgcctgatatttcaaatccgttttacggcgaactggccaaaagcattgaggaaagagcggatgagctcggttttcaaatgttgatttgcagcaccgattacgatccaaaaaaagaaacaaaatatttttctgtgctgaaacagaaaaaggtggatggcattatttttgcaacagggattgaaagccatgacagtatgtctgctttggaggaaatcgccagtgaacaaattccgattgccatgatttctcaggataagccgcttcttccgatggatattgttgtgatagatgacgttcgtggcggatatgaggctgccaagcatcttctgtcactcggccacacgaacatcgcctgcattatcggagacgggtcaacgacaggcgaaaaaaatagaatcaaaggcttccgtcaggcgatggaggaagcgggcgtgcccattgatgaatcacttatcatccagacgcggttttccttggaaagcggcaaggaagaagcgggaaaattactcgacaggaacgctccgactgctatttttgccttcaacgacgtattggcttgtgccgccatacaagctgcgagaataagaggcataaaagtgccggatgatctttctatcattggttttgataatacgatactcgcagaaatggcggctccgcccctgacaaccgtagcccagccgataaaagagatggggcggagcgtcatcgaactgctggcagaagcaatagagggaaaacgaaaggcgaaacaaaaaatagtgctcccgcctgagcttgtagtcagacattctacatcaccgctcaacacatgagcccgctaatgagcgggttttttcattatgacagttgaagcaaaaaaaaacatattgcgtgtaaaccaatggcagtgtaaaatgaaaccatcttttgagaaagcgcttgcgcaaaatggcagagcggatagaaccgctgtttttttagctgttaagagaaagcgctttctcaaagcgagcctgaaatgagataaaggagaggatgggacgtggaacatcaagtaagatgtgcagtattgggattaggaaggctcggttattatcatgcgaaaaatctcgtcaccagtgtgccgggggcaaagctggttagtgtcggtgatccgttaaaagggagagcggagcaggttgccagagaactcggtatcaaaaaatggtcagaggacccgtatgaagtgttagaagatcccggcattgacgctgtcattatcgtaacgccgacaagcacacatggtgatatgattatcaaagcagccgagaacggcaaacagatcttcgttgaaaaaccgctgacattaagccttgaggaatcaagagcagtttctgaaaaagtgaaagagacaggtgtcatctgccaagtcggctttatgagacggttcgatccagcatacgcagatgccaaacggcggatcgacgctggagaaatcggcaaacctatctattataaaggctttacgcgcgaccaaggcgcgcctcccgcagaatttatcaaacacagcggtggaatttttattgactgttccatccatgactatgatattgcccgttatttgctaggggcggaaatcacttctgtttcaggccacggcaggattctgaacaatccgtttatggagcagtatggcgatgtggatcaggcgctgacgtatattgaatttgactccggcgcagcgggggacgtcgaggcaagcagaacctctccatacggacatgacatccgggcggaggtgatcgggacagagggcagtattttcatagggacattgagaaatcaacatgtgaccatcctatcggctaaagggagcagttttgatatcattccagactttcaaactcgttttcatgaagcctactgcttggagcttcagcattttgccgagtgtgtccgtgatcgaaaaacaccgattgtgacagatattgatgcgacgatcaatttagaagtgggtatcgccgcaaccaattcctttcgaagcggcaggccggtacagctagatgtgaagcgcgcttatacaggtatgtaaaagctaacatgttgcatttgaggctttccgccaaaaaaaagcaaggacattttagcccttgctttctcttttctcatataaatagtacatataatcagtaggtactcctgaatggcccagctgtctcagcatggcggttacgttccctctgtggtaagtgccgtgattgacgacatgcaggatggtgtctgcataggttgattccagtgtacctagtttcggatgctgcattgtgaaggtctgttctaagtccgtctggcggctgaagaaatcatgatactgtgactccagctcggcagcgtgctgtttaatcgctgccatattaccttgcgcggactctaatttgcctgcgctgtctataatctcttggtaggccactcccgaaagaacattcagccaaatgtagtcagccctgcacatatgaagcagcacgtcgctgacagaaggaaatacgctctttacttcttgataggcagtttcctccggcagattttcgatatgggtaaatattttcttgtttgcccaagaatgatagtcataaaactgttttgcatcagtcatcagcatgcccccttttctaagaaattcgttttttcatctgtttctccttcaattgcaaaagagtgacaccccaaaatatcctgccgctgcccacattaccgctgcagagcatttgtttacgatcagcataagcctgccgctcgtatctatcgtctgaaacaatcggcccgctattgcaaggctgataaaccaaatccaagacacagcgatgcaggcggccataaagagccatttctcaagccccgaatattgaagagagctcgtgccgatgacgccgatcgtgtccagaatggcatgcgggtttaaaagagaaacagcggccgcaaacgcagcttgcttttttggtgtgaacgtatgtttctcattttggtttgtgttcggacggctgttccaagtcacccagcccatataaagcaaaaataaaaatccgccggccatcatgactgtctcaaacacaggcagctcctgcacaatgacagacacgcccgcaacggctaatacgattaacagggtatcgcagactgaagcactgatgacagctgggagagcccgccaaatatgcttttgccacgcgccttgctgaaaaataaacacattctgcactcccagcggcaaaattaagccaaacgcgagcacaattccgtgaatgattgcattcatgctgaaaaagctcccttcacattttttttcaatcataagagagattgtcactaaagtctccagccatttggttgggttaggaaccagccaaatgtataatgtgtaaaaaaggggggcatgaccttgtcgcaatggcagccaagccgaaagtcggatgttccgctgcatcggcagatcgaacaatatatgaaagacaagattcttcacggagagtgggctgtagggacgaaaatcccctcacagagaacgctggccggcatgtttcaagtcaaccgcagcacagtcacagcagccatagatgaactcacgtctcaaggcttgttagagggaagaagaggcggcggtacgaaggttgtaaacagtacttggagcgtgctggcggctgagcctccgcttgattggagcgattacgtccgttcgggcattcatcgcgccaattcttccatcattcaagctattaatcagaacgaaccaagagcggatatcatcagattagggactggagaactttcaccggatcttgtgcctgctgacacaattggacggatgtttcagcaaatcaatccgggcgtcctgtctttaggatatgagcagccgaaaggaaaccgtaaactgcgggaggcagtggccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagctgggatgcggcttcgcggcttgccgatggatgatgaaggggtcaaagcggggcttgtttcttctaatcgaaaacaatatggaggacagctgctttacacgattccgtcgtttcataatccgacaggcacagtcatgtcagagcagcgaaggaaagagatcatcagcctgtcaaaaaaagagcagatgcccatcattgaggatgatgcgtacggtgatttatggtttgaagaaaaacctccgcagccgttgaaagcaatggatcatgagggcaatattctgtatctgggcacgttttcaaaaacggttagccccggtctgcgaatcggctggcttgccggtccggagccggttattgaaaggttggcggacattaaaatgcagacagactacggatcaagcggcctgtcccagtgggcggctgccgagtggctgtcacaggggtattatgaagagcatctgacttgggtacgcaggaagcttaaagaaaggagagacgccgccgttcattttctcgagcggtatgccggggacattgccacgtggcggattcccgcaggcggcttttatatttgggtgacatttcacaaaaacctgcctgtcagccgtttcttttatggattgctgaaacggcaggtgcttgtgaatcccggctacatttatgacggtgaagaccgaaacagcatcaggctgtcatattcctatgcatctcttggagatttggaaactggcattaaagcggcagctgaaacagcacgccgcctgatgatgttctaagctttggttatacgatgacagctcccagtgccctggcgaaggcaatcgcgtgctcaggtgcgattttgcagcctttcaatttgtcgagggagacatgaagctgttcaaaacggcacgtgctgatgtccatgttttgaagggacgtgccggtaaagctggcgccttccaattcgcatccgtcaaagtgtgtctgctggagcaccgtatcgctgcattcactttgcataagagcacagtgatcaaatcgaacttgtttcatatttgaatacgaaaatgagctgaaatgtccgtggcattcctcgaatgaaacattccgcagcgttgcttccgccacattcattccaaccatttttgactgcttaactgaagttctgtgaatgacagccccgctgaaatcggcgtttgataaatcgcacttttcaaagatcacatcggtcagttcaatatgccgaaaagacacatcgataaagacgacatttctgaataccgttttttcaacacagagtctttcgatatcttcgccgcagatggtacaatcttcaaacaaatgcatgctgattacatcatcctgcgtcacggcatcatgaaaatctgcggtttgcaggttttctggtatgtttggtttttgaattgcgattttattcatgtgatgacatcctttgctgcccgaaaaacagaggcttccgggttcaatttaatagatcgttaaggaaattgatacatatagtaaatcatgaagagccttttcttggtacagcagcccgcttgttttgtaagcataaatggaaagcttcctatacgtcaaggcgtttacaggccgggaaagccaaagggaacaggaggaatgcggaatggggcattacatcaaaaccgaggagcatgtgacactgtttgtagaggatatcggacatggaaggccgatcatctttttgcacgggtggccgttgaatcataagatgtttgaatatcaaatgaatgagcttccgaaaaggggatttcgttttatcggcgttgatttgcggggatatgggcaatctgaccgcccttgggaaggctacgattatgacacgatggccgatgatgtgaaagcagtcatttatacgctgcagcttgagaatgcgattcttaccggtttttcaatgggcggcgccattgcactccgttatatggcacggcatgaaggagccgatgttgataagctgattttactgtctgcggcggcccccgcgtttacaaaacgcccgggttatccgttcgggatgaggaagcaggatattgacgatatgattgaattgttcaaagctgatcggcccaaaacactggctgatttagggaaacagttttttgagaaaaaagtgtctccagagcttaggcagtggtttctcaatctgatgctggaggcctcctcctacgggacgatccactcgggaatcgcattaagagatgaagatctcagaaaggaacttgctgcaatcaaggtgccgacgctgatcctgcacgggagaaaggataaaattgcgccgtttgattttgcgaaagagttgaagcgcggcatcaaacagtcggaattggttccgtttgcaaacagcgggcacggagcattttatgaggaaaaagagaagatcaacagtttgattgcgcagttctccaactcataagaaaaaacccgacattgatcgggttttttatataattcctctgttttgcagtgcgttaatgatgagatcagctccatcggaaatagaggtctggtctgactcaatgatgaaatcgggtgaaagcggcgcttcatacggagaatcgatcccggtgaaatgtttgatctctccgtttcgcgcttttttataaagcccttttggatcgcgctgttcacaaacatgcagcgggcacttcacataaatttcgaagaactcacctttaggaaagagtgctctaaccatgtcccgatcctctctgaatggagaaataaaagccgttaaaatcatttgcccgctgtcgacaaacagcttcgccacttctccgatccggcggatgttttcaatcctgtcaccagtctgaaatccaagatctttgtttaagccgtggcggatattatcaccgtcaagcacgtagctctgaatgcccttgcggtaaagcttttcatcgactgcattggccagcaccgattttccggagccggacaaacctgtaaaccaaaggacgcagcttttgtgtccgtttaaggactgtctgtcagactttgagatggcagcgggatgccaaatgatgttcggattgtgtgtcattgcaattccccgctgttttgtttgatggcaacaggctgttggtgaagtcccttgatcagcacggctgcgacctcaggccggctgaattctttaggcggctttttgccttggcggagaagctctctcacttttgtgcctgataagtggatgtggtctctcgggctgtgcggacatgttttggaggtgcccatgtttccgcattttcggcaataaaagctgtgctcaaaaaacagcggcttgatgcccagctcttcctctgtgaatgattgaaaaatattttgggcgtcgtatgttccatagtagctgccgacacccgcgtgatcacggcctacaataaaatgggtgcagccgtaattttttcggacgagcgcatggaaaatcgcttcccgcggacctgcataacgcatggcggcagggaaaaccgataacatgacacgatcctttggataatagtgattaagcaaagcctgatagctctccattctgatatcgctggggatatcgtctgactttgtttctccgacaagcgggtgaagcagcagaccgtcgaccgtttctaacgctgttttttgaatgtattcatgcgctctgtgaacagggttcctggtttgaaagccgacaatcgtcttccagccgagttttttaaaggcggctcttgtttcagcgggcgttgcataaaactgttcgaaagatttgtcaggcaggcggctgaccgtgataggccctccgatatagtaatccgggcgcgccagcaatttttttacgcctgggtgggcaggatcgtttgttttaaaaacagaaagtgcttcttgtgttttatcaggatggtatatatcggtgactgtgatcatgccgtaggtaacaccgtctttcacaagcttgacgtgatctccggcagacagctgttttgctgttttttctccgacaggcagcgtaatcggcaggctccacggcaagccgtttgccagcctcatctctttcacaacacgatgataatctttttctcccaaaaaacctgttaacgggctgtagccgccgatcgcaataagctccaggtcgctcagtgcaagctgatccagctctgcttggcacgcgcacccttcaaaatggcatgcgagatcacagcggttgattaatacccctccgtggggttcgtttccattcaacgtgttcaacctccatttatacgtttccttgttttcttttctgcacttaatgaaagtttgacatcagcgcctcaacatcatttcgattctcacatcaagaacctgccatcccctattcctgatgcaggccacattctgttttctcccgtccggcccatcttccagccctctcatcgttcgggtccggggaaggcaatgtacacatttcacagcctatgctcggataatgttgatcgtgcagtttgttataaggcaaattgtgcaggcggatgtacgtccaaacgtcatcccatgtccagtggatgagcgggcaaattttgatgagcttaaacttctggtccaggtttacgtattgaatatgctttctcgttggcgactgctcccggcgcagtcctgaaatccaagctgtcatgccggacaggtgctttttgagcggttcaattttccgcaattggcaacagaggttcgggttatgcttccatagctctccgccgtacttcgtcccctgttctgttaagctcagctcgggttcgagcatctggattgcaaatcccggatatcgctctttgacggtctcgatcagctcatatgtttcctgaaaatgaagcccggtatccaaaaagatgatgtgtgcgtttttgttgatttttgatattaagtctagaagcaccattccttctgcgccaaagctgcatgcgtacacaatcttttctccgtacgttcggtaagcccacttcaacacatcgagctcatcgatcaattgatccgttatctgattggacagcatgtcgttccatgtgtcatatgtgatggtttcgttcaacgttttccccccgtttgcatctgctttttttatctattgatcgagttataggcagactattcattttttgcataaaggttcagggtttttacgtgccgcgcccgcctaaaatgaggtgcggaaccattaagagcccggctgaatatgctttttagcaaaatggttttatgcccaaggagaggtagtatgccgatagccatttatcaggggcatcatcattcgcttgccccggcggacattaacatcgtcattgatgtcatcagagcttttacggtcgcccattatgcgtttatcggcggggcgaaagagattttgttggtccggacagctgatgaagcctttgcgctgaaagacacctatccggattatgttttgacgggagaggaaaagggggtcggtatcagcggatttgatttagataattctccaaaacgtatggctgggcaggatatggcggataagcgcctaatccagaaaacaacaaacggcgtcacagcagcattgggagcgctgaacgcaaagcatctgttcgtaactggattttccaatgccaaaacaacggcagagcatgtggaaaagctcgccgcaaacgattgtgtcataaacatagtggcttcccatccatccggtgatgacgatatggcgtgtgcggagtatatcaaaggcatcattgaagggacaaatgcggtaacggctgaggaggcgattcaaagaataaaacgctcttctgttgcggaaaagttttttgacagccgccagccattgtttgattcggaagacatcgtttactgtacaaaagaactgacgggcgattttgtgatgaaagtgaaacaagatggagaagttccaacgatagagagggtcataatatgaatgatttttcactagaattgccagtgagaacaaataagccgagagaaaccgggcagtccattttaattgataacggctatcccttgcaattttttaaagatgtcatagccggagcgtccgactatattgattttgtgaaattcggctggggcacatcattacttacgaaagatcttgaagaaaaaatcagcacactgaaagaacatgacattacatttttctttggcggcacactgttcgaaaagtacgtaagccagaaaaaagtgaatgaatttcatcggtattgcacctatttcggctgtgaatatattgagatttcaaacggtacgctcccgatgacaaataaagagaaagcggctttcattgccgatttttctgatgaatttcttgtgctcagtgaggtgggcagcaaggatgcggaattagcaagccggcaaagctctgaggaatggcttgaatatatcgttgaggatatggaagcgggcgcagaaaaagtgattacagaagccagagaaagcggaacgggagggatctgttccagcagcggcgatgtcaggtttcaaattgttgacgacatcatttcctcggatattgatatcaacaggctgatttttgaagcgcctaacaaaacgcttcagcaagggtttattcaaaaaatcgggccgaatgtgaatctggccaatattccatttcatgatgccatcgcgttggagacgctgcgtttagggctaagatccgataccttttttctgtaaaacagcggctgcggggctctcgtcgtgaagagagcctctgcctattattttttatggcggtacataggcgtgagatagggaagagaggtcaggcggatgttgtagatgaagtcgatgactcttgtcgatatcacctggcatatgagggcttgaatgacgatgccccagtcaataatagacgcggtgaccataaaaatgatgcaattcatgatgagcaggatcgttccaggattcccgccgcggtagatagaaatcatcagagcaagggctccgaatcctccgttcgaaattttatatttgtataaaagtccgatgccaagtcccaataacactgcgccgcttgccagatcaagccacagattagatgtgatatccggaaaaactgcatcaaagatcaataccgagacagaggtgacggtgatagaagcgagggtgccggtgaatgttctcatctccagccattttaaagcggtaaaaagcattgatacattcacagcccacactgaaaagccgtgggggatttgaaacagataatgcaatagcaccgcaatacctgctgcaccgcctgtcggaatatcatgcggaaataaaaacaaggacatgccgagtccctgtagtacgccgcctacgacaatcataaacgtaagttttgctttcatcagcagttcagccattaagtcatttgctcctttatgaaaagacttgtccgctgttttcattttatgaggctgtccattatttatgtctcaaaataaagaaatggcccagcttaataggctgagccatcccacttgtagcgattgacgatctccatattgatctctgttccaatgccttttcctttcgggatgtgggccattccttttgaaggctgcaggctgacgagatctgtaaaaggattctccatgacgtcccactcgatcggttcaatgtgatcgttcttcattttagaccatgggggcagacaggcttgtgcaaataaagcatagagccgtgaaagcgatccgtcatatgcatgggcggatgctctgacgccaaaataacgcgcgagctggaggcagtcccgaaactcatcaattccgttgacatgcatgacatcgggctgaatgatatccaaacagcgctgtgaaaggagaggcacatattgcgccgggcctttcatgttttctccgccggcaacaggaacagacaaacggcttcgaagcatagcgtaatcctgcggctgatcaaagggcaaaggctcctcaagccagccaatgttcgtccattcggagaaataacgctcccatttaaaagccgcagcggcatcgtagctttggtttgcgtccagaatcatcgtaatggagctgcctgctgtatgctgcagcgcattgatgtgccggacatcctccttgaatgaagtcccgccaattttgactttgatttgctcaaacccttttttcaactgggcttcaacattggagactgagcggctgatccattgcggggagtctgagtacgattgaaaagacacgtacacaggaatctcctctctgtatcgcccgccccataattcgcaaaccgaacaatccgcagctttggctgcaatctctgtcagcgccatgcttacagcggaggccgcccgctggtgccatttttgaatcgtgcgcactaatgacaggcggctgccagcctgttttcctaatagaaatgggatgatccgcttcgtaaaaccgacatggagagcagggagccaatcaacgcattctccccagccgtctatcccgctttcggtgataatcctgatgagataacaagtccgatatcgtttaaacccattggcatctccgtatggcttttctaatcggtgaaatagcggaaaggtttcaatccgtacaattttcacactgggtgctacctttcctcagcgggctggagccgattgccagccattttagggtcttctttttcttttgtttcttcattgttttgcttcacatggatgagcatcatcacaagaatcccgacaacgagagtcaatcccgcgatgcttaaaaacatgccgggtctggaccattgcatcaggcggccgaaaatcggaggaccgatcgctacccctaagaaacgtacagagccgtacagcgaggtgacaaatccccgtctttctttgccgacagccccggtaataaaactgttcacacaaggaaggacaagacctgagcctatactgctcagtacaagaacactgataaaaaggacaagattttcaatgaatgacagtgccgcgtaggatacggtcatgaacgccaatccaagtacgatcagctttttcattaacgattgcttttgcccgattttgcttcctgttgtataggacgtcacacacataaccaaaagcgggatcgctaaaatcaagccttttttcacgccgtcggtgtcgtatgttttttcaagaacatctgagagataaaacaggatgccgaataaagtaaacaaacaggtcgcaccggctaaataagcggtaaacagccatctgccttcgtgtttaaagacacttaacagcccttttgcatattttccgattggtggcggttctttttcctttttcttttctttaataaaaatccaagtcagtacgatcgaaatgatacaaaacacaggaaaggcaaaaaacgcgccataccagacaagcagggcgatcagcgagccaatgatcggcgatagcactttccccatgccgtttgaagcttcaacaaggccgagcaccttgctctcctgggcgcctttaaacagatctcccgtcagtgccatggcaattgggccggttccggctgccccgattccctgtaacgctcgtcctgccatgacccaaggataggcattgtcaaaaaaacctgccgcaaacccggctaacaaaccgccggcaccatacaaaattaagcagggaataatgatgactttccttgagaatcggtctgcgagataaccgacaatcggaatcgcaaaagctgcaatcaaggaaaatactgtgatcacgagactgacttgaaattgtgataaatgaagttcagatttcatttttggcaaaatcggaataagcatcgagtttcctagggttaatattaaagggattgaaccgattgctacaaccgtcattccgttattttgttttgatgattccatctcagagcacactccttttcttctgcttagaatgtccctgatggcttcgtttattcagcgatcagacagcaaaaaaccgaacagaagatacctgttcgggaaaaaagagggttaaccgagagcctgtgaaatcaaagcatataagtgtccattttgaataggcgcttttttctgataaaacaaaagcggaggttcatcatctttacgaaatcccatttctatcaggctgtcatgcagagacgtgtgttcactcggtatatcgattcgcatcggcccttgtttgccggccgccagcctgttaattatttgtgctgcaacatctgatgatgcagcgatgatagggccgaatttcaaattggccggtgtctgtacagaaagtccgtagccaattagctgtccgtcatgatttctggcgatgatacattcgcatgaagcagaaataagctgctgcaaaagatttgatcgatctccgccaaaggcttccagatccgccgcggttaagtcgtgaaagtcttgttctctaaaggatgtcagttcagcatcaagctttttagtataaggttgaaaactgtgacagctgtactttcgcactgaacctgccgtatgaaaacctgctttttcataaagcggcaaaccttcttttgtggcgcaaagcctgatggcggtgttttcacccgcttgggggatacaggcgtttaccatacgccggccgagaccaagccgttgatattctttgtccacgatcacgaggccgatagaagcaagccggccaaacaaaaacaagccgatgcaggaaataatatcaccgctgacattttgatagccgaaaaagcgtccttgctggacaagcagtgccagctcttgttcgccgtaatccggccacccggcttgcctgcaaagccgcaatagactagggatatgttcttcatgaagcttaatcagcttatcgattaccctcatacagattacctgcttgtttcgagttttttatacatgatgatatgagtgcctatgccgggaatctcaaacggttcgccgagtacttcccacccaagctttgaatagtagcctttcacatggcttctggcattgcaccagactgcctgaacgccgttctttgccagtttctcttccgcgtgtttgatcagcgtgctcccgcctttttgatcgcgatatccttcaagcgttgccatgcctctcagccgatatgctggggattctgttattaatggctgattttgcggggaaaaagaagcgatgctgatcagcttcccttcaaaaaacgcgccgagatgaaaggagccttttgcatgatcctcttcatatttgcattgttcaatggattgatggggacgcagaatgcggtgccggatttcatatgtatcttccgcggaaatggttttgacttcgagcataatgttcctcctcatgactgtttttctatatcgtaacacgaatcccgttgaaaaagaccgcccgattggatcagacagtcttttaagggattaatgcaaaaagatattttggcgctgctcatctttttgctgaatatatgaagtgagctcggcggtcaagtcagatctgaggaaaggcgttatcaagtagatgccgttaaacagctcgcatgccgtatccagcagggagcgtgcaatcgcaaggccttccgctttttgcttttctttatcttcaccggcatgggccattttttcgcgaatcgtatcagacagcttaatgccgggaatttcattatggatgaattcggcattccggctgcttgtcagcggcatgatgccgatatagatcggcgtcttcagatgttttgtttcgttatggatatcgacaagctgctgctcggaatagacaggctgagaaacaaaataatctgcgccgcaatctatttttttctcaagccgttttaccgctttatccagatggcggacgttaggattaaatgcggcggcaactgagaaattcgttttcttgccgagcggttttccagatagagacagaccttcattgaattgtttgatcagcctgattaaatcaaaagatgttaaatcatatacagacgtcgcaccaggaaaatccccgattttagaagggtcacctgtaatcgcaagcacgtcattcagccctaacgtatcaaggcccattaaatgtgactgtaagccgataatgttacggtcacggcacgtaatatggacaagggaacgcatatcgagctgttgcttgatgagagcgccgcaggcaacattgctgatccgcggggtcgccagagaattgtctgcgagtgtcagggcatcgattcccgcttcttttaattcagcagccgccgatagaaatttgtcaaagctcagttttttcggcgggtccagttctacgataatagagcgttttttcgctgcgatctcatccaggccgggctcggttcgctcgtgatgaacagaaatgaattctttcgcccgggttttgacttctttttctgtaatcggaaccagcccgccaaccgcttccgccatcgccctgatgtgattcggcgttgtcccgcagcagccgccgataatccgcgcgccttgcttacggaattctgacgcgctgttttgaaaatacgtgtcgtctgtttcatagacgagccgtccctcttcaagcgaagggagactgctgttcggataaacggataagaatacgtcatcaaaaatcggcacttcgctgagcgcttcaatcatgtgataagggccgaggcggcagttaatgccgacgatatcagctccgagatccgcaatcgagcgcaatgcgtcagaaagcggcgttccgtcctgcaatacgccttgctcgtgcatggagacattgagcataatcggaagatcagtctctttgcgcgcgattttcagcacttcatgggcttcttccaaatcataatatgtttctaacagcaagccatccggctcttcatgcagcagcagatacaactgctcgcggaagctgcgcttaatttcgtcaagactgtacgcgtttttattaaatgtccgtatgccgcccatcgttccaagcacgtatgcatcgcctgctgaagcccgcgcgatctttacggcctcctgattcatttttttgatgtcatcctcaagaccgtgtctggataatttaatatagttggccccgtacgtattcgtttgaataatgttggctcccgcttcaacatacgctttatgtatgcgctgaatttcctccggctttgaaatattgagctcttcaaaacacctgtcaatgccataggagtagaggagtgtccccatggcgccgtcaccgattaacacctgtctttgcaaatcttctaaaagtcccattgtctgcctcctttattcgcatcagcaaggaaaaaagagaaataaaaaaagtcctcttaagaagaagactttgtcagtgattttgtctcttcttatcttccaagctgttcgagcttgctggatttagcaccttggtcatggctgatcgccattacaccggttgctgaagcttcgtcgggccagtccctctgcttctcttgataagaacggatatgaaattttcgtgtcaggaagtgccaaaagatacctggcgtttttccctttctccaaatttaccgaaaataaagacaataatcaataggaatcaaaaaatttatctgaaatttataaattgaacgtcaattggcaggtctgctccccgcacagctgagataatctgctgcaggtcatctttgttttttccggtgacacgcacttgatcatcctgcacctgagactttactttcagtccggagtttttgatgatcgtattgattttttttgcgttgtccttgtcaatgccttgaacaagctttgcacgctggcgtaccgttccgcctgacgcgttttcaaccttgccgtactcaatgttttttgtcggtacgtttcgtttaatcaatttgctgacgagcacatctttcagctggcttaatttgaagtcgtcatcagaaacgaggaccagctcctctttatctaaagaaatgtcgcttttgctgcctttaaagtcatatcgggtactgatttccttcagtgcgatttggattgcgttttgcacttcaggcaattctaccttggatacaatatcaaatgagctttcttttgccatatgaaaacctccataacatttaacttatgtgttgattatagtagaataaagagaaacttccaacagaacaaagaatcaatttgtgatgattggaaaaaatgttaacaaaatccgcatagaataagcggaacaggaaggacgatagcatgagaccagggcagcaattaaccttgagtatagatcaccaaaccgacttcggttactttttaaccgatggggaagatacgattctcttacataacagtgaaatgactgaggatatcgaggacagagacgaagtagaagtctttatatacgtagaccagcaggaaaggcttgcggccacgatgaaaattccggtcatcagcgcggatgaatatggctgggttgaagtggtggataaagtggaagatatgggcgttttcgttgatgtcggtttatcgaaggatgcactagtcgcaactgagcatttgccgccgtacgaagatgtctggccgcaaaaaggggacaaactttactgtatgctgaaggtgacgaaccgggggcgcatgtttgcgaaaccagcgccggaagatatcatcagcgagctgtttaccgacgcttcagaagatctgatgaataaagagctgacaggtacggtgtacaggctgatcgcatcgggttcattcgtgatcacggatgacggtatccgctgttttattcacccgtcagaaagaaaagaggagccaagactcggttcaagagtcacaggccgggtgattcaagtgaaagaagacggttcagtcaacttgtcgctgcttccgagaaaacaggatgcaatgtcagttgatgctgagtgcattctaacgtatatgagaatgagaaacggtgccatgccgtacagtgacaaaagccagcctgacgatatcagagaacgttttaatatgagcaaagccgcctttaaacgcgcgctgggccatttgatgaaaaacggaaaagtgtatcaggaaaatggatggacatacgagaaaaaatagcatgaaaacggctcgcctgcagcagactgcggagcgagccgtttttttatgtctagtttaattcatcaaccagtgttctgattgccatttcgcgatccacattgtctgaaatcgcaatcggcgtaatatcaatggcgagaatgatcagaatcagggcacctgctgcagcaacataagaaacataatagaaatagttagcggtatcaacagtgttgacaagctcggcctgaactctggatgtatcatccttagaagcggcgatttcctttgcagcttctactttttcttcaacgatttgacctgcttttttcagcagttcatccactttcaatgcatctttgctgtaaacagctttcttcaggttatcaaaaaagtcagcatcctcttttttaatatcagcgacaacctgattggcaaaagcctttgcctgttttgtgttgagtttgtctgtcatcgctttattaaagacctctggaagctgtttgccaacttccccttgggcaaacacaaagcctttaaaaatttcctcacctgaatactcaagctgctttgcctgtgccacactttcttgctgcttcaccaaaaacacagtcgtcaccaatacaaccgacaaaaatactagaaacgccttcttcaaactgaaacctctcccttcttgtgttttttattccacaacagtctgcgaatatatgtaaattgaatcgtggaatcgataggagtgagatacaatatcaaaatgccggccatgataatcgaaaaactgatgaggcccagcatgactgcaaaaatctcatgcataaaaacagcgatgatcaaaatcaatctccaatgcttcttcggcgcaaacagcgccgcgaagatgacaatttgaaccagcagcgtcccccatgtcggaatcaccacgaacggacttgttacaattggcttcgttaacgcctgaaaaaagccgttgaagccaatggttttttcctgggcgaaataatagacggccgttccgtccacccattcctgctgagacagcttagcgacggtagagtgaaaataaagcaccgccacttggattctgatcacaaaataagaaataaaagctgttatttttccaagtgttcttttgccctctataggtctcgtactccaatgccattttctcggatcggtcagcgtgatgggaagcagtaaaaaggtcatgacggctgctgcctgctcgcctccgtcgatgacgatcagcgatgactgcaggctgtaactgacataccaatgcagaaccccggtgattctggggcgccagccaatgacaacaagcaccagaatgacaatgcagacccatctgaaaagatttaacatcatatagttattttcgccgaggcaaaagagactgagattcattttacaagctggatagctgctgatcccgctggctggcttcataatgaggctcgggtgattgatgagcagcgtcagcaggctggatagcgcaatgatgcttcgcgcgaggccgtatacatttgtccacgggtttctttcgtcccatctggtgatggtctgttttatgttttcgagcatgagatcacaaccttgactatgctttttacctgataagacgaaggggtgtatttagaatagctccaaggaacaatatcctctttcgtcaaatagtagctgccacaaagcagcgggcggggagcgggtgtttttaattgcacggttttggctttgcttttgcatgcgccgaggtccttttctttacatgctgtccactgttccttgtcgacttggctgtagatcacgcccatttcaacgccttgtgaccgcccataccgatataggccgaataggttgtcagccctcatattgggccatctgaccttggcgctggcattttcagcctcatataagccgattgcagtatcacgcggatttttgctgaaaaagccccagccctgagggaggatgctggacatgagaaatttggagtcctttgtcagcggaatcggggttgtccctaagctgccaataatagaaaacagaaatagcgaaccccaaaggattgaaaaaatgacaaaaaatgatatcgatttctgcattcgactgctccttttaacctgaagaatcgtttttacacttttcataatataaaaacatttatgtaataaaaaggttaaaaagtatgagaaattccatttttgttaaaaggaaaaacaggacattttacactgctatatgtgattgatatatagtggttttttcgatatatttaaaccatgaaaacgaatcaagttaatgaccgctggattgttcaatttcgaaaagggattttcgagctggccatcctatcccttctgcgttctaaaccgatgtacggttatgagctgacgtcatccttaaaaaccacctcggcgctggctatttcagagggagcgatttatccgattttgaaacgtatgaccgagaagggatggatcgaatttttttgggaagattcactggacggcccgaaaagaaagtattacaaaatgacgcaaaaaggagaagaaatgttaaaagaacggctggagaaatacctggaaacccatcaagccttactgtctttatcgggggatttgctatgaatggacagcttatcattgaccgatacatggaggaactaaatgcagagctggcgaatatgcctgatgtagagagagaaaacgctatcgacgaattaaaggggcatatcaccgctttcgttcaagacagaatcaaagccggccttagtgaagaggaactgcaggaagctgttgaatctgaattttctcatccgaaggagcttgccgaattgatgatgggtgatgggggagagacgaaaaggaggaggtctttattgggcaaaagctggctttcggtccttctcattgtcacgattatcgccctgccgctgctgccgtccgacttcagacagctgccgctggctgtttatttaatggtgctcgccggatatgtatggaagcggaaaaaattgatgatgtttgcaggtgtcagaaaaaacaaaatgcgctctcaaaaggagattgttacgatttcgcgagtcggtgcggtttatctgctgtttttagcagtgctgcttcttttgagcccgttcctcaatgcgcttgtcgtcctgctgctgattgcagtaagctgcgccgctttttttctttttcttaacatcaagtaatcttgtaggaggctgtaagatggaaatcagcatcaattatctattaattgtcatcgcgcttttattctttgtggttgcctattttgtcggaatcaaaaaacaaacctggatgctggctgggtttaacgaggcgcgtatacgggataaagaccggctggccagaatagcaggctactttttcttgaattccggtttgttcattttgctgaatagttttatctcatttcaaggtcaggagcagctcatacctccgcttatactggcatatgcagcaggggttattatttatgtcaataaaaaattagtagagtagaaaaagaagggtagagcgaaatatctccgcccttcttttttgggaaaataagaacgaagcaccacatacaagtttttgtatttttgataggatgaagaaaaatggtagattccaaaataggaaggatgtggtgttttgcgcaacctgaccaagacatctctattactggccggcttatgcacggcggcccaaatggtttttgtaacacatgcctcagctgatcaaagcatcaaatacgaccatacgtatcaaaccccttcatacatcatcgaaaagtcatcgcagaagccggtacaaaacacaacccagaaagaatcgctattttcctatcttgacaagcatcaaacgcagtttaagctcaaagggaatgcgaacagtcattttcgcatttcgaaaaccataaaggatccaaaaacaaaacaaacgttttttaaattaacggaggtttacaaaggaattccgatttacggctttgaacaagcggtcgcgatgaaggaaaacaaacaagtgaaaagtttctttggaaaggtgcatccgcaaatcaaggacgtctccatcacaccgtctatttctgagaaaaaagcaatacatacagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgatcctggctattggcattatttcatcgatgccaaaaacggaaaggtcattgagtcctttaatgccattcatgaagcggcaggtacaggaatcggcgtatcaggtgatgaaaaaagctttgacgtcacagaacaaaatgggcgcttttatttggctgacgaaacaaggggaaaagggatcaatacatttgacgcgaagaacctgaacgaaaccttgtttacgcttttgtctcaactaatcgggtatacgggcaaagaaatagtcagcggcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggaattctatgagcaaacaaaaacagtcagactctgtgtcctgactgtttttgtttgctcattttcttaaaaaaaatatcgccaatgtacctggaccggcatgcgagccgattgctgaactgattggatgcataatgatttctttcggcttgaacgcttcctcaatcaggtgtttcatgtccgtggctttttctttgttcgcggcgtagctgatcccgacggtttgattgctccaatcatccccgcgctctttcataagctcgatgatccgtttgaaaagtttcttctgtccgcggattttttccagaggcacaagcttgccgtcctccatctgaagcagcggtttaatattcaacaggccgccgacaaaagcggacgttttggatatccggccgccccttgcgagatatgttaaatcatcaacggtaaaaatgtgttcaagctggctgcaaaagttctttacagacgtttcaatttcttgtattgtattcccgttgatacagagatcggcagcatgccggacagccagaccgtatcctaatgaagcgcatttggaatcaatgacccgcaaatcgaaatcggggaattcctccttcacttcattggcgatcattacagctgtctgatacgtgccggagagacctgaggaaaaggcaatgtaaagagcgggatcacctgtttcggcatattgcaaaaacacatttttaatcgtttgcggtgaggcttgggacgtcttaggcgtttctccattttgcatcgcttcaaatatttgatccgcttgaattgtgattgcatcttcgaattctttatcgccgagagaaaccctgagtggaataaagccaatgcctttttcttcaaaataagaacgaggcaaatcagtggcgctgtcagcgatgagatgaactgtcatattgcttcccttctttccgttatcgctcgttatcatgagagttaagccaactatatcatattaatttgccaaaatcgtgttcaaatatttgttttaagggaaaacataataaagaagaaagagcggaggaacatgccatggtactagatcaaacaaaaaaattactcatcgtcatcatcggcgctttactcaatgctgccgggctgaacttatttttgatacctgcagatgtatatgccagcggatttacaggtgttgcccagcttttatcaagcgtcgttgatcaatatgcccccttttacatatcgacgggaacgctcttgttcctcttaaacattccggtcggtattttaggatggctgaaggtcggcaaatcgtttacagtgtacagcattttaagtgtcgcactcactactctgtttatggggatcctgccggaaacaagcctgtcacatgacattttgctgaacgcggtgttcggcggcgtcatttccgcagtcggtatcggcttaacattaaaatacggagcttcgacaggcgggcttgatatcgtcgccatggtgcttgcaaagtggaaggataaacccgtcggcacgtatttcttcattctgaacgggattatcatcttgacggcaggattattgcaaggttgggagaaagcattatataccctggttacactgtatgtgacaacaagggtgatcgacgccattcacactcgccacatgaagctcacggcaatgatcgtgacgaaaaaggcggacgaaatcaaggaagccatttacggaaaaatggtgcgcggcatcacaactgttccggcaaaaggagcttttacgaacgaacagaaagaaatgatgattatcgtcatcacgaggtatgaactgtacgatttagaaaagatcgtcaaagaagttgatccaaaagcatttacgaacattgttcaaacgacagggatttttggtttctttagaaaagactgacgaaagcaggtggaagtcgtgaaacggctgcttgtgatgctcctccccgtgctgcttttgataggctgcgggaaagatgagcagacagaacccgataaggaggtatcaggcggaatggagaatcaagaggttgttttatctattgacgcaattcaggagcctgaacaaatcaagtttaacatgtcgctgaagaaccaaagtgaacgtgctattgagtttcaattcagcacagggcaaaaatttgaacttgtcgtgtatgattctgagcacaaagaaagataccgttattcgaaagataaaatgtttacgcaggcttttcaaaacctgacgcttgaatctggagaaacatatgatttctctgatgtgtggaaggaagtccctgagcccggaacctatgaggtaaaggtgacatttaagggcagggcggaaaatctcaagcaagttcaggctattcaacagtttgaagtcaaataagaggctatggcgagtcgccatagcctttttttattgcagtttgtccagctgattttgaaattgatggagctgtcgacgttccgcatctgtcgaattggcatacgcagaagatacagcatttttggctctcagaatcgcttgctcctgatcgccttcctcaaagccgtttgtcaccatgaccgcctgttgaacaaatgattttgcctgctgaaacagttcatttctcatttaatattcaacctggctttcggccgagtctcgtgccgcggcatgctggtgagcttcttctaaagtagaccgatatggaaatcttgcggcgtgtagcccgatggagtctttaccctgctgaataaaccttctggatttgcttcgtttacccattttgagactgcccccttccatactttgacgagatgagtcgtcttcaatagtatggtggggcaaagtaaggtttatgagtgggaaaaattaatacggaccttctttaaagtgagaaatattctttcaaaaatcttgcaacgccgtcctcttcatttgtagccgttgttcggttggcaatctgcttgaccgcgtcaattccatttcccattgcaacgccgcagcctgcaaattcaagcatttccaaatcgttatcctcatccccgaaagcaatgatccgctccctcggcacgccgtaataatcgctgattttctgcaggccgaccgctttattcatgccgcttttgataatttcaatgacatgccacggtgcggcccatcttctatggtcgattacctcggcatgcacatccgataaatatgagcgtattgccggcacatcctcttcttttgcatgtatgagtacagacgtcacatcttcaccaagattttcccgcaagtctccgaccgttacatttgttgtgttcatgttaaaggcatctatcaggtgctcatcatggtaatgaaagtatacgtcgtcaatcacttcagcaagcacgttatgtacgttgtagctctcgctgatatccacgagctgtttgacaacatcaagcggcagtgacgtatgataccgtccccagctgtcgtcttgcgggtgatggacaaatgctccgttaaaattgacaattggcgttgtcagctccatttgctggtagtacatggaacttgaacgatacggacggcctgttgagatgcagacataatgcccgtcatcttttaggcgctgtatcgtctgaagggtgttttcagatatggttttatcatcctttaataatgttccatctaaatctaatgcgattaaataggggtttgtctccatgaaaagctcctttaaccttagattttgcttgttttgccttacttacagtgtagctttttaccatctttattgtctacatgttacacttatgattatggttatcctaaggaggggcacattgtgatacaaattgagaatcaaaccgtttccggtattccgtttttacatattgtaaaggaagagaacaggcaccgcgctgttcctctcgtgatctttatacatggttttacaagcgcgaaggaacacaaccttcatattgcttatctgcttgcggagaagggttttagagccgttctgccggaggctttgcaccatggggaacggggagaagaaatggctgtcgaagagctggcggggcatttttgggatatcgtccttaacgagattgaagagatcggcgtacttaaaaaccattttgaaaaagagggcctgatagacggcggccgcatcggtctcgcaggcacgtcaatgggcggcatcacaacgcttggcgctttgactgcatatgattggataaaagccggcgtcagcctgatgggaagccccaattacgtggagctgtttcagcagcagattgaccatattcaatctcagggcattgaaatcgatgtgccggaagagaaggtacagcagctgatgaaacgtctcgaattgcgggatctcagccttcagccggagagactgcaacagcgcccgcttttattttggcacggcgcaaaagataaggtcgtgccttacgcgccgacccggaaattttatgacacgatcaaatcccattacagcgagcagccggaacgcctgcaatttatcggagatgaaaacgctgaccataaagtcccgcgggcagctgtgttaaaaacgattgaatggtttgaaacgtacttataaagcacgaagttattaacaagagctgaatttacgttatactgtagaaaaaaggagtgagggaacgtggaagaagcattaaaagaaaacatcatgggcgccctggaacaggttgtcgatcctgagcttggcgttgatatcgtgaaccttggtttggtatacgatgttgacatggatgaagacggcttaacgcacgtgacgatgacactgacatcaatgggatgccctttagcgccgattatcgtggatgaggtgaaaaaagcattagcggaccttcctgaagtgaaagacacagaggttcacattgtatggaatccgccttggactagggataaaatgtccagatacgcaaaaattgcgcttggcattcaataaaacaaaagaggacagcctgacatgtgaggctgtccttttttacagctgaaaggagtgaaaggaaatgatgtacctgctggcagttttatgcccgccgcttgctgttttgttttcgggaaaaccgtttcaggccttgctgaatctcatattgacctgtatcttttggctgccgggcgcgattcacgcctgctttatcgtcgccgaccgccgtgccgaaaaacgggcaagaagataatttggaaaaatgaggacgcagtcatggtataatggtcataaaaaacagcagggagagcactatgaaaaagaaattgcttgcattcgcgctttgtactggcgcgtatgcggccctgtttgcgtactctgtgaactcagagcaaaaaacagacacaagcgagatgacggatgtcagccgcctgatgcctgtaaaaataaagcagacagtgaaagggcaggaagaggaaacgctcattgacacagtcaaagaggcaaatcgaaaaaacataaaaatttcaatcgccggggcccagcactccatgggcggccatacatattatgaggacggcatcgttctcgacatgacgggctacaacaaaatcctgtcactcgatcaagagaagaaaatcatcagggtgcaaagcggtgcaacgtggaatgatatccagaaatacgtgaatccatacggactcgcggtaaaagtcatgcagtcacaaaacatttttacaatcggcggatctctcagcgcaaatgcacacggacgtgatattcgctacggctcgctgattgatacagtcaaatcatttcggcttttaaaagctgacgggacgattatcactgtcactccaaaagatgatttgtttacggcggtcatcggagggtacggcctttttggcgtgattcttgatgtaacgcttgagctgacagatgatgagctgtatgtcatgaagacagaaaaaatgaattacagcacatacgcagactatttttcaaagcatgtaaaaggaaatccagatgtccgaatgcatctggcgcgaatttcaacagcgaaaaaaggatttctgaaagacatgtatgtcacaaattacgtattggctgatcatcaggatcaactgccatcatacagcgatctcaaagaagatgagtatacgggagccacaaagtttgcactcggtttgtcaagacggtatgaatggggcaggaattggctgtgggacacacagcaatcctatttcctgagccaaaacggcacagagatttcacgcaataacgtcatgcggtccgaatcaaagtttcttgagtatgaaaacaatgacaacacagatgttttgcaagaatactttgtgcccgtgaaggagtatgggtcctatattgatgacctgagacaaacgctgtcggacgaagatctgaacctgctgaacattacgatccgctacgtgcagaaaaatgaaaaggccgacctttcctatgcgaaggacgatatgttttcgctcgtgctattaataaacgagggcttttcaaaagaagaccaggcagatactgcccgaatcatcaggcgcatgacagacgttgccatcaagcacggcggcagctattatctgccttatatgacctaccagacaaaagcgcaaatgagacaggcatatccgaaaagtgaagcgttttttcagaaaaaacgaacctatgacccggatgagcgctttatgaattacttttatcagaggtataaataatggggaaaaacaaattaaaatggctgacattatcacaaagcagcgtgtttttcgcaagcagcttaatctttccgttttatattctgtttgtgaaaaatatcggctcaagctacacacagttcggtttttcctacggattgtttgggttgagcggagcgctcatttacccgctcctcggacggctgtctgaaaggtttgacagccgttattttctgcttctgaactcgtgggggatggctgttctgcttttatatgtcccgcatatcggaagcgtcgttcaagtgtatatcgtccaagtgctgttagggctctttggagcgatgcaaaagcatggagaaaaagtgctgatcgctaattttacagacagcggagagcgtggaaagaagattgggaattaccatttttggacggctgtcttttcagcagcagccattatgcttgggggctttctcgctgactttttcacagtgcaaatgattttttatgcaagctctattctatattttttgagtggattgatgatgatgaaaacaggctgacgcggtcagcctgtttttttatgcggctgaaatgcggcgccgcatcaacgtttttgtgctggagtcgtgctgatttttttgagcggaatttccattgaacagaaaatttataaatgaataaaaatattaaatatacgattgaattaatttttattcatgttataatgttaaataatttcacaaagaccaagagggtgaacttgttttgaaaataggaattgtaggtgctacaggatatggaggcgccgaacttgtcaggattctttcgcatcatcctcatgcagaggaatgcatactttattcatccagcggagaagggaatgtctatagcgagggttatcctcatcttaccggcttagcggatcagaagctgaagccgattgatatgaatacgatcaaacacgaaatagatatcatgtttctcgctgcgccgcccggagtatcaagtgaattgactccaaagctggcagacgcgggaattccggttattgatctgtcaggtgatctgaggatacaagaaccggctgaatatgaaaaatggtataaacggacagcggcaccgaaggcagtgattcaagaggcggtatacggtctggcagaactgaatcaacaacaaattcaacaggcgaaactcattgccaatccaggctgttttccaacagctgttttgcttggcctcgcgccattggctcaaaagaatctgctcgatgaatcttttgttatcgttgacgcgaagaccggtgtttccggagcgggaagaaaagcatccatgggaactcatttttctgagctgaacgacaattttaaaatttataaagtcaatgaacatcagcacacgccggaaattgagcaggcgctgaatgaatggcagccaggtctcgggcccattacattttcggctcacttggttccgatgacaaggggcatcatggcgacgatgtataccagattaacctgtgacctatccgcagatgacctgcatgatttatattcggaattttaccaagattcatattttgtgagagtgaggccaaaaggtcagtacccgcaaacgaaagaagtgtacggcagcaatttctgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcactatcacgccaatttatccatagaacgggagagaatcgaaccatgattcagttaagtgaagatcaaattgtaaaagtaacaggggatgtatcctcgccaaaagggtttcaggcaaagggtgtgcattgcgggctgcgctactcgaaaaaagacctcggcgtcattatcagcgagacaccggctgtgagcgcagcagtttatacccaaagccactttcaggctgctccgatcaaagtgacacaagacagcttaaagcacggaccgacactgaaagccgtcatcgtcaacagtgccattgccaatgcctgcacgggagaacaaggcctaaaggacgcatacacaatgcgggagagttttgcttcacagcttggcattgagccggagcttgtcgctgtttcatcaacgggtgtcatcggcgagcatttagacatggaaaaaatccacgcggggatcgagctgctgaaagaaacacctgcgggatcaggcgattttgaggaagcgattttaacaactgatacggtgatcaagcagacgtgctatgaactggcaatcggcggcaaaacagtcacgatcggcggagcggccaaaggctctgggatgatacacccgaacatggccacgatgctgggatttgtgacaactgacgcggcaatcgaagaaaaagcgctgcaaaaggcgcttcgggaaatcactgacgtttcatttaaccaaatcacagttgacggagaaacatccacgaacgacatggtattagttatggcgaatggctgcgccgaaaacgagtgcctgacagaagaccatccagactggccggtctttaaaaaagcgctcttgctcacttgtgaggatctagctaaagagattgccagagacggagaaggcgcgacaaaactaattgaagcccaagtacagggagcgaaaaacaatcttgatgcaaacgtcattgccaaaaagattgtcggctcaaatcttgtaaaaacggcagtatacggaacagatgccaactgggggcggatcatcggagccatcggacactccgcagcacaggtgacggcagaagaagtagaggtttatcttggcggccaatgcctgtttaagaataacgaacctcagccattctctgaatctatcgccaaggaataccttgaaggagatgaaatcaccattgtcatcaagatggctgaaggggacggaaacgggagagcgtggggctgtgacctgacctatgactatatcaaaattaacgcgagctatcgcacgtaataaaggggagcgaaatgaagaaaacaatcgtttttaaatgcggtggaagtgtcatccgtgagctgtcggaggaattttttcaaaatctgaaagagctgatggcgtcaggctggaagctggcgatcgtacatggcgggggaccggaaatcacgaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcaggcatttctggtaaggatggaggtcttttggaggctgattatctagatccggaaacatacggagaagtgggagaaatcaaaaaagtcgatgcgtccatggtgaacgcgctgatggaaaatggcatcatccccgttattgcgccgctgtctatgacaagcgactgtaaaacgctgaatgtaaatgctgatctggctgcttcagcagtcgccggagcgcttgaagccgataagctgatgttcgtcacggatgtcgatggaatcatgaaggaaaagcagcgtctggacgtcctgacccctaaggagattcagatgctgatcaagcaggaagtgatcacaggagggatgatcccgaaagtcaattcagccttgtcagctttatcagatcaggtgtctgaagtcatgatcgtaaacggaaaaggatcattcttcgcagaacaaacctttcaagggacaaaaattgtcaaagcaaaggaggctgtttcatgagcagcttgtttcaaacctacggccgttgggatattgacatcaaaaaagcaaagggaacgtacgttgaggatcaaaacggcaaaacgtacctcgatttcattcaggggattgcggtatcaaatctaggacactgtcatgaagcggtgacagaagcagtcaaaaaacagcttgacagcgtatggcacgtatccaatctgtttcaaaacagtctccaagagcaagcagcgcagaagctggcggcgcatagtgcgggagatcttgtctttttctgcaacagcggcgcggaggcgaatgaaggtgcgataaagcttgccagaaaagcaactggaaaaacaaaaatcatcacttttcttcagtcgttccatggccgcacgtatgcagggatggctgcgaccggacaggataaaatcaaaacaggcttcggcccgatgcttggaggctttcactacctgccatacaatgatccttctgcttttaaagctcttggggaggaaggcgatattgccgcggtgatgcttgaaacagtgcagggagaaggaggagtcaatccggcgagtgctgaatttttatcagccgtacagtcgttttgcaaggaaaagcaagcccttctcatcattgatgaaatccagaccggcatcggacggacgggaaaaggcttcgcatatgagcacttcggactctcaccggatatcatcacagtcgccaaaggattgggaaacggctttccggtcggcgctgtcatcggaaaaaaacagcttggagaagcgtttacccctggttctcacggaacgactttcggaggaaacatgctggcgatggctgctgtgaatgccacattgcaaattgtattccagcctgactttttgcaagaggctgctgacaaaggagcgtttttaaaaggacagcttgaggcagagctaaagagcccttttgttaaacaaatccgaggtaaaggattaatgcttggaattgagtgtgatggcccggttgctgacattattgctgaattgcagacattaggcttgcttgtattgccggccggcccgaacgtgattcggctgctgccgccgctcaccgtgactaaggatgaaatagcagaagccgtcagcaagctgaaacaggcaatcgctcatcattccgctgtaaaccagtgattttttttcgatataaaggcataaaaattcatttttataattaattattcatcaagaggtgggctgttagatggaaggttatttagtgttagaagatgggacatcgttcagcggcgagctggacggtcatgaaaactgtacgggagaagctgtttttttcacaggaatgacaggctaccaggaagtgctgacagatccatcgtataagggacagattattgtatttacctacccgctgattggcaactacggcataaatgaaaaggattttgaaagcaagaaaccgcaagtaaaagcagcggttgtctatgaggcgtgtgatcacttttctcattatgaagcggtatacagcctcaaggagtatttacagaaatggaacattccgctgttaacccatgttgatacgagggctgtcgtgaagaaaatccgggcaaacgggacgatgggtgcgacagtcacagcctctaaagaaggagctgagattgcccttcaaccagagaatgtggcagagcaggcttccgcccaggaaatcagcacattcggcgacgggaataaacatatcgctctcattgattttggctataaaaagtcaatcgcatcatcacttgtcaaacgaggctgcaaggttaccgtggtgccataccagcaaatggaggccgtatacaacatcaaacccgatggcattgtgctatcgaacggacctggagatccgaaagcaatccagccatatttaggaaagatcaaaagcatcatcagccgctttccgactctcggcatttgtctcggacatcagctgatcgcgctcgcgttcggagggaatacttttaagctgccattcggacacaggggagctaatcatccggtcatcgaccgtgagacgaaacgggtctttatgacaagccaaaaccacagctatgtggttgatgaacagtcgattaatgaagaagagctcacgatcaggtttcatcatgtcaatgatacgtcagttgaagggcttgcccataaaaaactgcctgtcatgagtgttcaattccacccggaagcccatcccggacctgcggaaagcgaatggatttttgatgattatctaaagaatgtgataccagcaaggagagaaatcgcgcatgcctaaagacaccagtatttcaagcatattagtaatcggctcaggcccgatcatcatcgggcaggcggcagaatttgattattcaggcactcaagggtgcatcgcgctgaaggaggagggctaccgggtcattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagaccgcgttgaatttagcggtggagcttgaagaaacgggtgttttaaaagagcacggcgtcaaactcctcggcacatccgttgaaacgatacaaaaaggagaagaccgggaaaaattccgttcgttaatgaatgaattaaaacagcccgtgccggagagtgaaattgttgataacgaggccgatgccctccattttgcggaatccatcggttttcctgttattatcagaccggcttacacattaggcggaaagggcggaggaatcgcccctgataaagaagcctttacagctatgattaaacaggcgctattagcaagcccgatcaatcaatgccttgtcgaaaaaagcattgccggctttaaagaaattgaatatgaagtcatgcgtgacagcaataacacatgcattaccgtctgcaatatggaaaatatcgatccggtcggcgtgcatacaggtgactctatcgttgtggcgccgtcacaaacattgacagacgaagactatcaaatgctgcggacagcaagcctgacgatcatctcagcacttgatgttgtaggcggctgtaacattcaattcgcgcttgatccattcagcaagcaatattacgtcattgaagtgaatccgcgtgtaagccggtcatcggctctcgcatctaaagcgaccggttatccgattgcgaagatggccgcgaaactggcagtcggatacacccttgacgagctgaaaaatccgctcacaggctcgacttacgcaagctttgaaccggcactggactatgtgatcgtcaaatttccgcgctggccgtttgataaattcaaaaacgcagaccgcaagcttggcacaaaaatgaaagccaccggtgaagtgatggcgattgaacggaatttagaagcggcgatacaaaaggcagccgcgtcgcttgaattaaaaaatatcgggacacaccttccagagctcagcgggttgtcaattgatacgctatgggatttggcaatcactccggatgaccgcagatttttcgttgtcatggagctgttgagccgcagcgtgacgattgatgacattcatgcgaaaacaaaaattgatccgtttttcctgcatacctttaacaacatcatcaaattggaaaaccgcctgatggaagcagggagtgatctctcttttgaattattgaaaaaagcaaaggaaaagggattctcagacgcaacgattgcctcactgatcggcaaaacagaggtagaggtgcgcgcgcttcgcaaggagatgggcattacaccttccttcaaaattgtcgatacatgcgcggctgagtttgatgcgaaaacaaactatttttactccacatatttcggagaaaccgatggagacatcagccgcaaagagaaaaaacgcgcgctcattatcggatcaggcccgattcggatcggccaaggcgttgaatttgattacagtgcggttcacggcgtgctgacactgcaagagcttgggttcgaaaccatcatgattaacaataacccggaaacggtcagcaccgattatgaaattgcggatcgcctgtattttgaaccgatgacaacggagcatattgtaaacgtggcggagcaggagaatattgattttgcaatcgtgcaattcggcggccaaactgcaatcaatgctgctgaagcactcgaaaaagccggcattacccttctcggcacttcgtttgaaacgctcgatgtgttagaggatcgggatcaattctatcagcttcttgacgagctgggagtgaagcatgcaaaaggagaaattgcctatacaaaagaagaagccgcttcaaaagcgagtgagatcggctatccggtgttaatccgcccatcttacgttatcggcggaatgggcatgatcattgttgactcgcaagcccagctttctcagctgctgaatgatgaggacagcatgccatatccgattttgattgatcagtatgtgtctggaaaggaagtcgaaattgatttgatttccgacggcggggatgtctttatcccgacatataccgagcatattgaacgggcgggtgtccattcgggggacagctttgccattcttccaggaccgtccatcacgagcgggctgcagcagggcatgaaagatgcggcacaaaaaattgcccgaaaactttcatttaaaggcatcatgaacattcaatttgtgatcgacaatggaaacatactcgttcttgaagtgaatccgagagcgagccgcacggttcctgtcgtcagcaaagtaatgggcgttccgatgattccgctcgccacacgactgctagcgggagcgtccttaaaagatctaaatccggcagttcaaaatcatcatggagttgccgtgaagttccctgttttttcttctcatgcgatccaggatgtggatgtcaagcttgggccggaaatgaaatcaacgggagaaggcatgtgtgtcgcatatgatgctaacagtgccttgaaaaaaatctatacaagagtctggagtcaaaaaggcagcatttatttgcaaaacgttccggaagatgtgaaggagttagcagaaaacgcaggttttacaatacatgaaggaacatttgcctcatggatggaacaggaagggaaatcgctccacattaatctgagcggttctgaagaagcacgcaaagaacgtttggaagccatgacgcacggcatccccgtctttacagaagaagaaactgtgcgggcgtttttacaaagcggttcaggccatccgcagcctgtatctctcaaagacctctataaaaaggaagtggcatcatgcacacagtgacgcaaaccagtttatacggaaaagatttattaacgttaaaggaccttagtgaagaggatataagcgccttgctcgcagaggccggtgagctgaaacaaaacaaaattcagcctatattccatggcaaaaccttggcgatgatttttgaaaaatcatcaacgcggacacgtgtttcatttgaagcgggcatggcgcagctcggcgggaacgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttaccgataaataccacccatgccaggcgctggcggatctcttgacgattaaggagataaaagggaagcttaaaggcataaaagtcgcatacatcggtgacggaaataacgtggcgcactccttgatgatcggctgcgcgaaaatgggctgtgatatctcgatcgcttcgccaaagggatatgaagtgttagatgaagcagcagaagcggcaaaaacatatgcacttcaatccggctcttctatcacgctgacagatgatccgattgaagctgtaaaagacgcggacgtgatttattctgatgtgtttacaagcatggggcaggaagcggaagagcaagaacgtcttgctgtctttgcgccttatcaggtgaatgcggcgcttgtcagccatgccaagcctgactatacatttttacattgtctccctgcgcatcgtgaggaagaagtgactgcggagattattgacgggctgaactctgcagtgttccagcaggcggaaaaccgtcttcatgtgcaaaaagcactgctgaaggccattttatacaaaggggaatcatcaaaaaactgctgagccaaactcagcagtttttttgatggcaacatattcacagccgcttaggcgcatactacagcaaaaaggaaaaggaggaaaaacagtgggacagcagcaccaattccggcccggacagaaagcgcctaataacggtgtctacgtagaaatcggcgagacagggagcatggttaaaaaccctcaaaaggtccatctgtcagcaggggaaatgtttcccgaaacatcaaaccacaaccggctgtggacctacaaaagaaagccgtgaccactaaaaaacccaaaacaataaatgttttgggtttttggctttttaatgctggcttgcatttttgttcataggcatgatttctgctaaaaccatgattaagacatacagtacaacagcaatgacagatgatgttttgaaattatacgtaacgctgttcatgcttgcaaccaagtagcatgccatatgtgataaaaggaacgtccaaataaaggcaataatatatcgcacgtttccacctcgtccttctcattctattctaaaagttatcataccatacaaaaagcgaagggggaatccaattttagcagaaagtgaggtgacaaaagagtctgattcgtcacactttaatggtaaaatataaaacgtcaatcagtataatagccaaaaatgtaaaaggctaggactttaccttattcgtttcttttctatttacataagatagcgtgagatgaagtgtgaaaggaggcgggcaagcgatgggaataacggaaagatactttcaactgggaacggagcataatgtcattcatctgccctatcgcccgaacggcttcggcatctttatcttgggggacagaacccactttgtcggacatgattcaagcttttggcagcagcattatggcagaaatcagcttctgagcatgttgatgaatgaaggatacactctttttaacagcaatctgttcggaaggcattggggggcggaaaaagcagtcacctatgccaaacagctgatacattctgtgttgaagcaggaaatcctcaatccgaagattcatattttagcagaaggcatgggtgctctcgtggccgatgaactgcttcgtttttccccggatcatatccgctcagccgcaatgttgaatccttgtctcgatcttcaggcacattatgaatcggaaaaagaaaataaatttttctataagcaatttttgaaagaagtatcgaaaagctacggaatttctgaaaaagaagcggaagcgattcgttataaaacaattcaaagctacccgagcggcgtaccggttcatatatggcagcgtatgaccggagctccatatccctacagtgtacatgcggaagttttcaaggaaaaacagcaaaagcaaggctcaccggtcgacatgacatttcatttatttgagcatccaagcagaatttatgcatcaatttgcaaattctttcacagtcatgaaaaagaattatagagaatataatgacaacagccttctcttttgcggaggctgttttgttttgggaaatgaaaaaccggaagggcggcagatgcaatggaatcaacgctgattgtaggtgcggacgaatttttcggcctttcattatgtgagcgaatgatggatgaaggcatacatgttgacgttgttctggcggaaacagaagataaaatgagacaaatgtacttagaagaaagactcatgtggcttgggagaaatgaactctttcgccagcttgagcacattggagatcaaaagtatgatacaatttgtatccagttcggaagttttttgcctttagaccaatgtgattctccttatattttagtatatgaagaagaccgaaaagaatgggaaaaacgtgaaaaaacaggctcggaaaaaaccgtgatcctgccgaaaatgtatgggccatggaaagaagaaacagaggaaaaaggctattacacaaacgacgtggctgacgagttgctgagattcctgttagaaccaagccgtcatagcaaagatcagctttttgaattgcaagtcacagagaaaacctcaaaagaagaagcaaaaacaaaaattatcgagtggaaaagacaattttcatcaattttcgacaaatattaagaaaaaccttccatgtttcgagttttctagatacaataaacgtataaaaataatacatgttatagcttgtcaaaaggagttgaacatgacttgatcacaaggcttgtcatgatcttttctgtcctccttttattgagtggatgtggacaaactccgttcaaaggaaaaattgagaaggtcggcatgctctttcctgatacgattaatgacctcgtatggggcacaaaagggtataaaggattactgaatatacaatccaaatacaatgtggacgtctattataaagaaggcgttaaaacagaagaagatatcataaatgcgattgaggattttcataagaggggcgtcaatctgctctacggtcatgggagtgaatatgctgaggtgtttaacttggtcggcgaagattatccagatatggaattcgtcatttccaatgcgaaagcgaaagctgataatgtaacgagtgtccattttagcggggaagcaatgggcttttttggaggaatgactgctgcccatatgtcgaaaacgaatcaggtcggtgtaattgcctcctttacgtggcagcctgaggtggacggttttatcaaaggggccaagtatgaaaatccggatatagaggtaaatacgaaatatacggatcattgggatgatgatacaacagcagtaaagctttatcagaaaatgaagaacgaaggcgcggatgttgtgtatcccgccggagacgggtataatgttcctgttattcagcaaatcaaaaaagacggtctttatgccattggctacgtcacagatcaatcggatctgggcgagaataccgtattaaccagcacggtgcaaaatgtggacaaggcctatgaaatcattgctgaacaatttaataaaggcacccttgagggcggcgatcattactacgacctgaatacgggagtcgttgagatgggaacattcagcccgctcgtcgacaaagactttcagcaaagaatcgccaagctgatcaaaacatacaacaaaacaggcgagctgccaaaaaacgagtaatggagtgacgtcacatgcagcacgaaaaatcacttgaattcttgcaaattgccatgaaatatctccctgaagcgaaagaacagcttgagaaatcaggcattgagctctcaatggaggccatacagccgtttatgaatctatttacaacggtaatggcggaagcttatgagcttggcaagtctgacgctaaatctgaaacagaataagaagaagccacttttttgaaagtggcttttcacatgattttctttttaatagcggagagcatgggcgcaagctcctttaaagcgggcttgatttgatcaagagagttcataattgaaccgatttggtccataatatgcatgtaattaatcgtctcttcgtcgtttgtctgagaaacctgagaaacttcctcttgctgttcctcctccttctcttctgttggttttgctgcatcgccgaacatcattcttgaaaacacatccaactgcatacgcctcctttccatataccatactctatgagtaagatgaactgatagtttagacgaatatattgccatgtgaaaaaaaataggatagaattagtacctgatactaataattgatcacaacctgattgatcttctaaatttaagatataaaggagtcttccctaatgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcatttcctacggtctcttgtatgattcaagaacagctcggcgcgaagaaagcgtgtgctatggatatcagcgcggcttgtgcgggcttcatgtacggggttgtaaccggtaaacaatttattgaatccggaacctacaagcatgttctagttgtcggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgccaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataaaaaaaggtgaggtgcacacaagatgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagatgcagatcttaacattaccgatgagatcgcaccgagagtcggtgtttgggtaggctccggtatcggcggacttgaaacattagagtctcaatttgaaatcttcttaacaaaaggcccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggcgatgcagacgtgatggtcacaggcggaacagaagcgccgctgacaagaatgtcattcgccggctttagtgccaacaaagcgctgtctactaatccagatccgaaaacagcgagccgcccgtttgataaaaaccgtgatggctttgtcatgggggaaggtgcagggattatcgttcttgaagaacttgagcatgccctggcccgcggcgctaaaatttacggagaaattgtcggctacggatcaaccggagacgcttatcatatcacagcgccggcccaagacggtgaaggcggagcgagagcgatgcaagaagccattaaagatgcaggcattgcacctgaggaaattgattacatcaatgctcacggaacaagcacgtattacaacgacaaatacgaaacaatggcgattaagactgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacacctgacgaagaatgtgatttggattatgtgcctgatgaagcccgcagacaggaacttaattatgttctcagcaactcattaggattcggcggacacaacgcaacattaatctttaagaaatatcaatcataatcaagccaaaccggctgcccttaaagggtagccggttttttttgtgtgcatacgattaaaagaggaggcgatcacatgagtgtagaacaaacatatagctggctcaggaaggctgattcaatagatgatttggcgcattacattatcccgcttttttcaggtgcggagaaaaagaactggaatggcattctgggacaccttcagcatcatgggatgtttaaaaacataaaagagggtattcagactgtttccaagctgaaggaaaaaggtttttacggacatatccaaaaggaagaacagtacctcaaaaacaaatggcaaggtcctgatgtaccaattgtcacgctgccggttgatgaacgaaacaggagaatccgtttagaattcggatcaaaatcaggactcgcctttcaagacaaaatgttcctttttctttcgtcagatttagattttgggtcggtatctgcccttatgacgcatgagtatcatcacgtttgccggttaggtcatctgacaaaagaggaaaaggatgtcacattacttgatacaatcatcatggaagggctggcggaatatgctgtttatgagaggttcggccgaagtcaaacggctgagtggacgacttggtatacaccggagcagcttcaggctttatatgaaaaaaagattgcgccccatcgggatatcaaacgggataatcgattatttccccagctgttattcggcaaaggatatcagccaaaaatgcttggatacgcagttggattcaatattgtaaaaaaatatttaactgccagcaaggcaagcaccgcagacggactgtccattcctgctgaaacctttttggatgcaatgctttaaaaggataaaataatggaatttcattaataatattacatttatcctaaaaaattcttgattttgcaaaatgattgtaataatatacaactataaaatttttcgataattcaatattatttattatttctgaataaagggattgctttctcttgaaaacgtttgacaacaagaggggggaaaggggagctagcatgagcacacttttagaagtgaataatttaaagacttattttttcaggaaaaaggagccgatccctgcggttgacggagtcgattttcacatcagcaaaggcgaaaccgtcgcgcttgtaggtgaatcgggctccggaaaaagcattacttctttatcaattatgggcctcgtccaaagctcaggcggaaaaatcatggacggctctattaaactcgaagacaaagacctcacctcattcactgaaaacgattattgcaaaatccgcggtaacgaagtatccatgatctttcaggaaccaatgacctcccttaatccggtgttaacaatcggagaacaaattaccgaagtgctgatttaccataaaaacatgaagaaaaaagaagcccgtcaacgagctgttgaactcttgcagatggtcggtttctcccgggcggagcaaattatgaaggagtacccgcatcggctgtccggcggtatgagacagagggtgatgattgccatcgcactgagctgtaatcctaaactgctcattgccgatgaaccaacgacagcgctggacgtgacaatacaagcccaggtgctggagctcatgaaagatctctgtcagaagttcaatacatcgattcttctcatcacacacgacttaggtgtcgtgtctgaggctgccgatagagtgattgtcatgtactgcggacaagtcgtagaaaatgccactgttgatgacttatttttagaaccgcttcatccgtatacagaaggcctgcttacgtcaattcctgttatagatggagagattgataaattaaatgcgattaaaggcagtgtgcctacaccggataatctgccgccggggtgccgttttgccccaaggtgcccgaaagctatggataagtgctggacaaatcagccttcgcttttgacacacaaaagcggaagaacggtgagatgctttttatatgaggaagagggtgccgaacaatcatgacagcagctaatcaagaaacaatcttagagcttcgtgacgtaaaaaaatactttccgatccggtcaggcctttttcaaagaaaagtcggtgatgtaaaagcggtggatggtgtttcattttcgttaaaaaaaggagaaacactcggaatcgttggagagtcgggctgcggaaaatcgactgccggcagaacgatgatcagactgtacaaaccgacagagggccaaattctttttaaagggcaggatatttccaatctgtcagaggagaagctgcggaagagtgtccgcaaaaatattcaaatggttttccaagatccatttgcttcgttaaacccgagaaagaccctgcgttccatcataaaggagccgtttaatacgcacaacatgtataccatgcgtgaacgaaacgaaaaagttgaagagctgcttgcaagagtagggcttcacccgtcgtttgccagccgttatccccatgagttttccggcggccagcgccagcggatcggcattgccagagcactcactttgaatccagagctgatcattgcagatgagccggtttccgcacttgatgtatctattcaggcccaagtgattaacttgatggaggaattacaggaagaatttaatcttacgtatctatttatctctcatgatctgagtgtcgtacgccatatcagcgacagagtcggagtaatgtatcttggcaaaatgatggaactgaccggcaagcatgagctttatgacaacccgcttcacccatatacccaagcgcttttatcctccgttccggttacaagaaaaagaggatctgtcaaacgtgaacgtattgtcctgaagggagaactgcctagtccggccaacccgccaaaaggctgcgtattccacacaagatgtcctgttgcaaaaccgatatgcaaggaacaaataccagaatttaaagaagctgctcccagccactttgtggcttgtcacctttatagctaatgttgcccgcacagctttgagagggggtatgcgcactacataaacaacagctgagaagaacgaacatttcaagagggggaatatctaatgaaaagacggaaaaccgcactgatgatgctaagtgtattgatggtcctggccatctttttatctgcctgctcgggatcaaaatcaagcaacagcagcgagaaaaaatcagcaggcaaaccgcagcaaggcggggatttggttgtaggttcaactggggagccaacgttgtttaacccactctattctacagacgtttccagttcagatattgaagggatgatctatagtacattattagaaacggatgaaaaactaaatgtgaaacctgctttagctgagaaagtaacagaatccaaagatggcctgacttatgatgtcaaaattagaaaaggtgtaaaattccatgatggaaaagaacttacagccgatgacgttgttttcacttatagcatacctttaaataaggactataatggtgaacgcggttctggttttgaatcactaaaatctgttacaaaaaaaggtgattatgaaattgaatttaaattaaagaaaaaggatgcgtatttttacaatgttgttttaggcagttacggtattctgcctaaacacattttagggaaagtgcctgttgcagatttaggcgaaaatgaatttaacaggaagaatccaattggttcaggtccattcaagtttgttgaatggaaaaagggtgattatgtaaaacttgaagcaaatgatgactactatggcggaagaccgtatttagatacagtgacagttaagacgattcctgattctaatgccgctgttgctcaattaaaagctggggatattgacttctttgttgtaccaggcacagactttgagacagttaaaacatttgataatgttcaagttaaatcagatcttggtttgaactacagttatattggatggaatgaaaaaaatgaattatttaaagacaaaaaagtccgccaagctcttacgtatgcgcttgatcgaaaagcaatggtagatcaggtgttaaatggtgatggtaaagttgcaaacgttcctgaaagtccgctttcttggaactatccaaaaggtgatgtacctacatttgattacaatcctaaaaaagctaaaaagctcttgggagaagcaggatggaaagatacagatggagacggttaccttgataaggacgggaaaaaattctcatttaccattaaaactaaccagggtaataagattcgggaggatttagcagttgttgttcagcagcaacttaaagaagtaggaattgaagcaaaaccgcaaattgtggaatttagtgctctaatcgaacagacaaatccaccaaattgggattatgatgcattgttgcttggatggagtctagctacgttccctgaccaatacacgatcttccattcaagtcagtctaaaaatggattgaacaatatttggtacaaaaatcctgaggttgataaacttttagttgaggcaaagtcaattacaaacagagaagaatatcagaaaaaatacgaagaaatctataaattgattgctgaggatcagccttattcattcctgttttattacaattatcatagggcaatcccgacaaacatgcatggatatgtattccatccgaaaaatgacttatatcatattgaaaaatggtggcttgaacaataataattaaatccctagagaggggaggatcaagcaagcatcctttcctctttatcctattttagaaaaggggacaagaatatggttacatatattgttcgtcgaacattaatgtctctgccaattcttttgggcattacaattttatcatttgcgataatgaaagcggcgccaggtgatccgatgtcacttatgatggatccgacaatcagccaagctgacagagcgaaatttattgaaaagtacgggctcaatgatccagaacctgttcaatacttaaaatggctaggaaatatgctccaaggcgactttgggacatctattgtaaaaaaagggacaccagtttccgatctaatcctttcacgtttaccgaatactctggtgcttatggttttttcaactcttgttgctcttctgatttcaattcctttcggtgttctttctgcaaaacgcccttattctaagcttgactatggtataaccgtcacgtcatttttggggctggcaataccaaatttctggttcggattaattcttattatggttctttccgtaaatctcggttggtttcctacgggaggtgtcggcactttaaacgctgactttaacatttttgataggctccatcatttaattttacctgcgtttgttttagcaactgcggatatggcaggtattactcgttatacaagatcaagtatgcttgatgtattaaagcaagattatataagaacagctcgagccaaaggattcaaagaaaataaagtgattttcaaacatggtttgagaaatggcctgcttcctgttattacaattttcggattgatgattccatcatttattggcggtgctgtagtagttgaacagatttttacttggccgggattagggaagttatttattgattcggcattctctcgagattatccggttattatggccatgactgtaatttctgctgttttggttgtactggggaacttgattgcagatattttgtatgcattagttgatccgagaattgaatattaaaagggggagacacatatggcacatccaaacactgcggctccctctaatgaggtaaagctaaaagaaaatattagaaaaaaaccagaaacaatgactaggatcttttttgagaaatttttcaaaaataagcttgctgttgttgggggtatcatattaacagttattattttaatggcagtctttgccccttttattgcgccttactcacctgagagtcaatcacttttaaacaaactgaagccgccaagccctaaaaatctaatgggaacggataagtttgggcgagatatatttacaagggtgttatatggagctcgtgtgtctttattagtcggttttgcttcggtaattggtgcgattactataggtacggttgttggagctgtagcagggtactttaaaggaatagtagatgctgtattaatgagggctgtcgatgtagtcttatctattcctgatatttttctgcttattaccttggttacaatttttcaacccggaatggataagttaattttgattttttctttgacgggttggactacaacagcgagactagtcagaggtgagtttttatctctaaggtcaagggaatttgtattggctgctaaaacaataggtacaaaaaatcacaaaattattttttcgcatatattaccgaattgtatcggaccaattattgtctccgctactctaaaagtaggcagtgtcattctagctgaatcaacgctaagctatttgggtttcggtatccagccgccaatcgctagctggggaaacatgcttcaggatgctcaaaactttacattaatgattcaagcatggtggtacccgttatttcccgggctatttattttaatgaccgttttatgcttcaactttgtcggtgatggcctgcgggatgcgcttgacccgaaaaatattaaataaaaatgaatatcatatctgttataaaatatcaccaaatcagaaaaaaagcaggtctccttttgtcagaaaatatacaaagagatctgctttttgtgattcttgcataaaaccagtgattccagatttcctcaatctctttggaataatttctctatcccttgcctatactgtggacaacagtttttataaaagtgaggggttagagatgttatttcttcatgatgtgtgggtcaattggtttgaaggggaagaaaatggctacaatgtatgccactttcacgaatggcgcaaggaagatacggttgagcttttggatcaggtgccgctgttaagggtgccgtcagtactgtttcattacatagaaaacgatttgtcagagcttccgaaaggtttgcttgaagacgtacatcagaaatcgtacattcggaaaaatcatgagcggacaaagcttgagtattgttttgtcgtaacagacggaatcggcattttagctgtcgacacgatcggctacacgatccctgtcagaaaaagccgtctgatcccaagacaggagcagctcgtttatgaaatggtaaaagatgtagagcctgaaacatatgaatttgagccaaagaagctggaatcctccaaggaatatcacatcttatcattagcaccagaacatgtcagaggacttacaagaaaagaacggcaaattaagcagctgatgtttatggcgcttgaccaattgaaagggctgaaaaaccgggcggaaatcggctactggtacacagagtggaatccgcatatgtatgaacaaatcaaaaggatgagctttgaagagatttgggacatgctgtataacgaaacaattgaaggctggtcggacaaacacctagctttttgcgaaaacttaataaaaggacagccttttttcgaaaagctttgggaaatggaaaacgaatcaaaggtcaactgaaaaaaaccgctctttgcaaagagcggttttttgattagcgtctttttcttccaagacccatggcattctccatttttttcagcattttgtttgctgtccggttcgctcgttccgcgccttcatcaagaatccggtctaattcttcagattctatcagctcgtaatagcggtcctggatcggttttaatgcgttcaccacgacttctgccaaatcacctttaaactcgccgtagccttttccttcgtactttgcttcaagctcttcaattgtcgtattgccgaggattgaataaattgtaagaaggttggaaacgcccggtttgttttccttatcaaatttgacaatgccttcagaatccgttacagcgcttttgattttcttttcaagctgcttcggctcatccagcagggtaatataagctttctggttcggatcagatttgctcatcttcttcagcggatcattcagagacatgatacgtgcaccgacttttggaattttcacttccggaatcgtgaagatgtcgttgtattttttgttgaagcgttctgcgagattccgcgtcagctcaaggtgctgcttttgatcctcaccgacaggcacaagatccgttccgtacagcagaatatcagcggccattagcggcggatatgttaacaggccggagacgacagcttcattgcctttggatttgtccttaaattgagtcatccgctcaagctcgccgatatatgcgacacactgcatcatccatccggcctgcgtatgcgcggggacctctgattgaataaacaatgttgctttttctggatcaagtccgacagctaagtaaagcgctgcgagattgcggatattctttctaagctcaagccggtcttgaggaacagttatcgcatgctgatcgacgatgcaaaaatagctgttataatcatgctgcagttcgacaaactgcttcattgcaccgatatagttgccgagcgtcactgagccgcttggctgaatgcctgaaaaaatcgtttgtttcatgaaaacatcaacctcatttcttaaaacataataaaaaaggctcattcttcccctgtaaaaaagggacgaatgaaccgtggtaccaccctgattattccattaaaatgaaatcactctgacgtttgtaacggagactgctccggctgagcctacttttttccagttcggtcagctgctccaaagtccattccacattgcccgttatctgctcccagcaccgcagactctcttcaaacaggtgaaatgtgtactactctttttcatagcacgcttttcttttgattgcttcattataaatcaattataaccaattgtcatcatgaaaaaacattcttttttccagtaaaattgtaataatataaataacacgggtgctgtaaaatccttaaatgataactgctatcagcgtaaaaacaggcagatattatatgtaaaaagcaatatgggcagaaaacacatgaaaaagtttttaatcaatttatgctttaaatggtagaaggatattatgttcatggaagaaaaactaacgaagtttaaatattttaaattgataaaataatattgcaataaattatttgtttcattataatgaacttgttcactctattgttacagcttttttacaaaaataatcagaaaagacggaacagaataaaagttgtggaaactcaggttcatttgtctgatatttctgaggatttagccgtaaggagctgaaaattattattagggggtttgcgaatatgaaaaaacgttggtcgattgtcacgttgatgctcattttcactctcgtgctgagcgcgtgcggctttggcggcagcggatcaaacggtgaagggaaaaaggacagtaaaggaaagacgacacttaacattaatattaaaactgagccgttctccttacatccgggattggcaaatgattcagtatcaggcggtgtcatccgtcagacttttgaaggattgacacgtatcaatgcagatggtgagcctgaagaaggcatggcttctaaaattgaaacgagcaaggacggaaagacatatacatttaccattcgtgatggtgtgaaatggtctaatggagaccctgtaacagcacaagattttgaatatgcttggaaatgggcgcttgatcctaataacgaatcacaatacgcttaccagctctactacataaaaggtgctgaagcagcgaataccggcaaaggcagcctagacgatgtggcagtaaaagctgtgaatgacaaaacgctgaaggttgaattaaataacccgactccatatttcactgaattaactgcgttctatacgtatatgccgatcaataagaaaattgcagagaaaaataaaaagtggaatacaaatgccggagatgattatgtatcaaacgggccgttcaaaatgacggcatggaaacacagcggttctattactctcgaaaaaaatgatcagtattgggataaagacaaagtcaaactgaagaaaattgatatggttatgatcaacaataacaatacggaactgaaaaaattccaagctggcgaacttgattgggccggtttgccgctcgggcagcttccgacagaatctctcccttccttgaaaaaagacggttctttacatgttgagccgatggcaggtgtgtattggtacaaattcaacactgaggctaagccgttagacaacgtcaatatccgtaaagcattatcttatgcgattgaccgtcaatcgattgttaaaaacattacgcaaggtgaacaaatcccggctatggctgcggtgccgccgacaatgaagggatttgaggataacaaagaaggctactacaaagacaacgatgtcaaaacggcaaaagaataccttgaaaaaggcctaaaagaaatgggattaagcaaggcttctgaccttccgaaaatcaaattgtcttataacactgatgatgcacatgcgaaaatcgctcaagctgtacaagaaatgtggaagaaaaatttaggcgttgatgttgagcttgataactcagaatggaatgtctatattgataagctccacagccaagattatcaaatcggccgtatgggctggcttggggactttaacgatcctataaacttcctagaattgttccgtgacaaagacggaggaaataacgatacaggctgggaaaacccagaattcaaaaaattgctgaatcagtcacaaactgaaacagatcaaaacaaacgtgcagagctgctgaaaaaagcggaaggtattttcattgatgaaatgccggtagctccaatttatttttatacgattccttgggtacaagacgaaaatctgaaaggaactattattactggaactggagaaatttacttcagaaacgcgtactttcaataagtcttatttgtgaaaacaataacctcaaggtatatggggacctatttcccatatacctttcttactgaagaatataaaaaagtaaaaaccatggaggtgttcccccttgctaaaatatatcggaagacgtttagtctatatgattatcacactatttgtgattgtaactgtgacattcttcttaatgcaagcagcaccgggcgggccattttcaggtgagaaaaagcttccgcctgaaattgaagcaaatttaaatgcgcattatggcttggacaagccgctgtttgtacaatatgtcagttatttgaaatcagttgcaatgtgggatttcggaccgtcatttaaatataaaggtcagagtgttaacgacctgatcagttcaggtttccccgtttcatttactcttggagcagaagctattctcctcgctttagcgttaggtgtattgtttggggtcattgcagccctttaccataataagtggcaggattataccgtcgcgattttaacgatatttggtatttcggttccgagctttatcatggcggctgttctgcaatatgtgttctccatgaagcttgggctgtttccggtcgcggggtgggattcctgggcatacacctttttgccttcaatcgcacttgcttccatgccgatggcgtttattgccagactttcccgttcaagcatgatcgaagtgttaaacagtgattatatccgcacggcgaaagcgaaagggctgtcccgcccagcggttacagtgcggcacgccattcgaaacgcgcttttgccggttgttacatatatgggcccgatggccgcacaggtcttaacggggagcttcattattgaaaccatttttgggattccggggcttggtgcacacttcgtcaacagtattacaaaccgtgattatacggtcattatgggtgtaacggtgttcttcagtgtcatcttgctattgtgtgtattaatcgtagatgtgttatacggcattattgatccaagaatcaagctttccaaagcaaagaaaggagcctaggccatgcagaacattccaaaaaacatgtttgaaccagccgcagcgaatgccggcgatgcagaaaaaataagtaaaaagagcctttccctctggaaagatgcgatgcttcgcttccgcagcaataagcttgcaatggtcgggcttatcattatcgtacttattatccttatggcaatttttgcgccgatgttctcaaggtatgattattcaactactaatctcttaaatgcggataagccgccttcaaaagatcactggttcggaacagatgatcttggacgggacattttcgtccgtacatgggtaggggcgcgaatctcaatctttatcggtgttgcagccgctgttctcgatttgctgatcggcgttatttgggggagcatttcaggcttccgcggaggcagaacggacgaaatcatgatgcgtatcgctgatatcctttgggcagttccttcattattaatggttatcttactgatggttgttcttccgaaagggctatttacgattattattgccatgacgattacgggctggattaacatggccagaatcgtgcgtggacaagtgctgcagctgaagaatcaagagtatgtgcttgcttcacagacactgggtgcaaaaacatcccgtcttctgtttaaacatatcgtgccaaacgcaatgggttctattttggtcacgatgacactgacagttcctactgcgattttcacagaagcctttttaagctatttgggacttggtgttccggctccgctggcaagctggggaacgatggcttctgacggattgcctgcattgacctattatccgtggcgtttattcttccctgccggatttatctgcattacaatgtttggtttcaacgttgtcggcgacggattaagagacgcattggatcctaagttacgtaaataagggagtgatacgggtgacacgcctattagaagtaaaagatttagcaatttcatttaaaacatatggcggagaggtccaggcgatccgcggagtgaatttccatctggataaaggagagacgctggctatcgtcggcgaatcaggttccggaaaaagtgtaacctctcaagcgattatgaagctgattccaatgcctccgggttatttcaaacgcggtgaaatcctgtttgaagggaaggatctggtgccgctgtccgaaaaagaaatgcaaaatgtccgaggaaaagagatcggcatgatatttcaggatccgatgacctccttaaatccaacgatgaaggtcggtaaacaaattacggaagtgctttttaaacacgaaaagatctcgaaggaagcggctaaaaaacgcgcggttgaactgctggaattagtcggtatcccaatgccggaaaagcgggtgaaccaatttccgcacgaattttcaggcggaatgaggcagcgggttgtcattgccatggcgcttgcagcgaatccgaagcttctgatcgccgatgagccgacaactgctcttgatgtaacgattcaagcgcaaattttggaattaatgaaggatttgcaaaagaaaattgacacgtccatcatctttatcacacacgatcttggtgttgtggctaacgttgctgaccgggtcgctgtcatgtacgcgggacagattgtagaaaccggtacggtagacgaaatcttctacgatccgagacatccgtacacttgggggcttcttgcatccatgccgacactggaaagttcaggagaggaagagctgactgccattccgggcacaccgcctgatttgacaaacccgccaaaaggagatgcttttgccctgcggagcccttatgcgatgaaaatcgattttgaacaggagccgccaatgtttaaggtatctgatactcattatgtcaaatcgtggctgcttcatcctgacgcgccaaaggtagagccgcctgaagcggtaaaagcgaaaatgcgtaaactggcaaatacgtatgaaaaacctgtcttagtgagagaaggtgaatgaattgactgaaaaattattagaaatcaaacatttaaaacagcactttgtcacaccaaggggaacggtcaaagctgtagatgatttatcatttgatatctataaaggtgaaacattagggctggttggtgaatcaggctgcggtaaatcgacaacaggccgaagcattatccggctgtacgaagcaaccgatggtgaggtgctgttcaacggcgaaaatgtgcacgggagaaaatcgcggaaaaagctgctggaattcaaccgcaaaatgcagatgattttccaagacccatatgcatccctgaatccgagaatgacagttgctgatattattgctgaaggccttgatattcataagctggcaaaaacgaaaaaagagcggatgcagcgagttcatgaactattggaaacagtgggattaaacaaggaacacgcgaaccgctatcctcatgaattttccggcggccagcgccaaagaatcgggattgccagagcgcttgctgttgatccggaattcattatcgcggatgagccgatttccgctttggatgtatccattcaagcgcaggtcgtgaatttaatgaaagaactgcaaaaagaaaaagggctcacatacctgtttattgcccacgatttatcgatggtcaaatacatcagtgaccgcattggagtcatgtatttcgggaaactggttgagcttgcgccggcagatgagctgtatgagaatccgcttcacccgtatacaaaatcattgctttctgcgattccgcttccagatccagactatgagagaaatcgcgttcgccagaaatatgatccgtctgtccatcaattaaaggatggggaaacgatggaattccgtgaagtcaaaccgggacattttgtgatgtgcacggaagccgaatttaaagctttttcatgattcatcaatccttcaagagaatctcttgaaggatttttttgcgtcctcatagaaagtgagaatgatatcatttacaattagaggaaaaagcggaggcgaaatacgattcaatttctgcataacaaaaatgtttttgcgctattgctgtctcaatcttttcaatctttagcaggagtcctcgtcacaatcgttttaatggtccgggtctatcaaatgactgactccgtttttttggcaggccttattttatcgttcatgtcgtttgcgagtatagcagcaagcttttgcgtctctccggtgcttcgcattctcggttttaaaaaggtgcttgcgggagcgaatctgctgagagcggtctttacaatcctgatggcatacagcgtcactcatcacggacaggcattcttttggattacgctgctgtttgtgttttgtttttccttcgcgggcgctttttttcagccggcaagatttgcgctgctgccgattattgttccaaagaagcaatatgtaaaagcgaatggtgtgatctccctctcgaatcaattgttcttaacagcaggctggggccttggaggccttctgacgtacgccgtcccttttgaactcgttgtcggcgctgccatttgcctgttagttctatcgggagcttccatcagtgtgctgcatgtaaatgaagaagaggctgtaggaactgctgaaacagcatctgccagaagtatatggaaggatttaatgatcatccctattgtaagagacattactgtaatggacgtgatagaagctttggcgggttccgtatggtcatctgctattctcctcgcatttactgcggctgttttgcatgaaacagaggtgtggtgggggatgtttaacgcttcctattttataggcgcaattgtcggcagtgtgattgccattcgtttttcttctttttttgagcggaatatgggctatgccattatgttcagctcgcttgtaatgtcggcgctgacccttttgttttcattttctccagtcccatttttatgcgctctggcttgtgctgcaatggggcctttttatcaggtgcgtgatatttgccaggaaaccatgctgcaggaggttattcccgagcagaaacgaatcggaatcatggctgcaaaaaatgcgattttgactccttggtcaggcgtcacctactccattatggggctagtggctgatgctgctggtgcgaaaatagcttttatcgcggctgctgcattatatatcatgacatttctgattgcactggcgcagccccgcctgattcattacaggcgggaaaaccgagttcaatgagatacacttcaaaatgaacggagcagctggctccgtttttgctgaaaaaaaatgaaaccatggcggaagttcgcacgtctttatagatgtaaggctgtttaaacaagaagaaatggggtatatctaaaagtatgaagacaacgaactcataaggagcaaatcaatgaactggtatgaaaagcttagcgagtactttccaattgaagaaatgaaatcaaaagcgcatatggaagctcttctgaaagagcgaagcgatatttatcataaagatgaaggcaaacatcatattttaatgtttgcggagttcgattcttttatcttcgttgattatctgtatgtgtctaaggatgcaagagggcaggggcttggcggcaaattgatcgcgaagctgaaaaagaaaaataagcccatattgctcgaggtggaacctgtggatgaagatgatactgatacagaaaaacgcctgaggttttatcaaagagagcatttcaagcatgctcagtcaattgggtaccggcgccggtcattggctacgaatgaagtaaacaagatggagattctgtactggtcaccaaaaacagaatcagaagaagaaattcttgaagccatgaaacagacatatgaaaacattcatacttataaagacgagaaatggtacggagaatcgtacgaaaaaacggatgaagtcctgaaactcattgatgaagaaaaacaaaaaaatattttcgatcagttaagctaattgagaattagaacatatcatgaacattaaaaatttgctggattgacacatttttttcttaggatactgttcacacttacttttttatagtataatacctgtaaagattccttttttagagtaatttcaatttaagaataaaatagatgttcatcctactaattagaggagtgaagatgaatggttacactatacacatcaccaagctgtacttcatgcagaaaggcgagagcgtggctcgaggagcacgatattccatttgtagaaagaaacattttctctgaacctttatcaattgatgaaataaaacaaattcttcgaatgactgaggatggaacagatgaaatcatttcaacccgttcaaaagtattccaaaaactgaatgtgaacgttgaatctatgccgctgcaagatttgtaccgcttgatcaacgagcatccaggtttgcttcgccgtccgatcatcattgacgaaaaacgtttgcaggtcggatataacgaagacgaaatcagacgtttcctgccaagaaaagttcgctctttccaattaagagaagcacagcgtttggcaaactaatagatcgtatcatcaaaagaaggctgagtgatcagccttcttttatttttcaacctgctggtaataaatgctcgcaaggatgacaaacgcaaccgtcaaaatggggaggagcgtttcgactgtgccgtgctgcgccataaaaagcgacagctttttgtctctgacaatcatttctccgccagtataagcaagcagcccgcttcccgcgtaaatcagaagcggtattttctctagtgcaatatggatgagtttgctgccccaaataataaccggaaccgatacacacaaacctataacaacgagagaaaactcaccgcgtgatgctcccgcaactgcgatgacgttgtccagcgacataaagagatctgcaagcacaatcgttcgtatcgctctccacagggaggtgctgcttttaatgtgcttcgtgtcttttttttcaatcagcagctgatatcctaaatacagcaggaaaattccgccggcgcactgcaagaacggaatgttcaaaagatatactgctgcacttgttaatccgattctcatggcaacggcaataaatgttccgagaataatggcttgctgtctctgcttgtccggcaaatgtctgctggccatggcaataacaaccgcgttatctccgccgaggatcaggtcaatcccaacaatgacaagcagagaaatcagatactcatgctccatgaagcggcacctcgctttcagtccttcgcttgtactactactatatgagacaggtcatattttatgatatcagccgcctgatctgccgttttttaggcaaaggtgcatttttatttcttttgtgactgttttatcataaaatagaaatacaaaggaattcacactggccttggttaaggttaagatgtggacggaatgggtaaagtgtagtaaagtacaattaatcgggagcttagatgtcccttcaacatcttatatagaagggaaggttggcaaatggaaattgaaagaattaacgagcatacagtaaaattttatatgtcttacggagatattgaagatcgcggttttgacagagaagaaatttggtataaccgtgagcgcagtgaagaacttttctgggaagtcatggatgaagttcatgaagaagaggaattcgctgtggaaggcccactttggattcaagttcaggcactggacaaaggattagaaatcatcgtcacaaaagcccagctttccaaagacggacaaaagctcgaactgccgattcctgaggataaaaagcaagaaccagcatctgaggatcttgacgccttgctggatgatttccagaaagaagagcaagccgtcaatcaggaagagaaggagcaaaagcttcaatttgtcttgcgatttggcgattttgaggatgttatttctctatctaatttgaacgttaacggaagcaaaacgactttatattcgtttgagaaccgatattatttatatgtagatttttgcaatatgactgatgaagaggttgaaaatcagctaagcatcctgctggagtacgcaaatgaatcctcaatcagcatacaccgtcttgaagagtacggcaagctgattatttcagagcatgctctagaaacgataaaaaaacactttgcatcatagcaaaccgatttccttccggaaatcggttttttttatgcacgaaaatgccattttagagatgtgaaaaatcaaaaacatatagacaagcggaaaatacagcgaacaggagttgatcatcttttccagaaagtatacttcatctggaaaggagagatgacaattgtttagtgctgtgactgaagacggccaaatgtttcaccttctaggcgctcagcaaaaccagaaattaaagcggagacggttcttctgtccggtatgcgggggagagctagctgtgaagcttggacttcaaaaagcgccgcattttgcccataaacagaacaaatcctgctccatagacatcgaaccggaaagcgcctaccacttagaaggaaaaagacagctgtatgtatggctgaaaacgcaacgggcttcaccaatattggagccgtatataaggacaatcaaccaaagaccggacgtcatggcaagaattaaggagcatatgcttgctgttgaatatcaatgcgccactatcgctccagatgtctttcaaaagcggacagagggcttcaaacaagaaggaatcatcccgcagtggattatgggatacagccgcttaaaacggactgcttcgtccttttatcagctttcagcttttcattggcagtttatcaatgcaagtccatacagagaactgatatgttattgtcctgaaaggcgttcttttctccggctcagccacatcattccattctacacaaaccattcttattcctcagtccaaacgatccctatccatcgggcaggtgcagacgatctttttttcactgaaccgaaaccctcaatccaatattcaggctggacgaaagcgattcaccgttttcgccataaaccccatcggtttaactcaaaggaaataaatcgccttaggctgctgttttatgagaagcagcagacgcctttttcttttctgccaactgaagtgtttgttcctgttagaaaaggggcagtttttaagagtccggtttttgtgtggcaagggtttctttatttgtttatgacggatcttggagataaacgtgcgccaattcgtttttcagccgttttgcagcagtgcaaactgcacatttataataagaacattgcactcaggtttgaatgcagcgaagagtgtctttcagaagcggttaaacagtatattgattttttgtgcaagaagggatttttaagggagactcagaaagaagtatatgtgctgaatcagcctgcaggcggcatacactccatgcaggatctcatagaaagagaccgcagctgttttatagaatgagtttgtcttatttggctcaccctaagacaaaggtggtgggcaggctgtgaaaggcacaaaaggaaaggtttttcgtgtttttactgcttttttggcattcgttctcttcattactgcatatgatttgacaaaaggcagtgaaaaaccggaagatattcacaacacaagtttattgagaaacagctgttttttcaattggcttgaatcaaagaagacgagggggatcaccatggctgaggaaaaaaaagcaaaccaactgcctgacagaagtgaggtaaaggcagaagacacatggagacttgaggatatttttcctagtgatgaggcctggaataaagaatttcaagctgtaaaagaattaattccgaatttatctaagtataaaggaaagctggcagattcagctgatcatttatacgaggctcttacgtatcaagataaagtgatggagcggctgggtaggctgtacacatatgcgcatatgcgctcagaccaggatactgggaactccttttaccaggggctgaatgacaaggcgggaaacctgtatacacaggccgcaagcgcgacagcttatttggttccggagattttatccatagaagaagacaaactgcagcagttcattcttgaaaaagaagaattgaaactgtactctcatgcgattgaggagattacaaaggaacgtccgcatgtgctgagcgagaaggaagaggcactgcttgctgaagcctccgaggtactggggtcatcttcaaatacattcagcgtgttaaataacgcagatataacgtttccgtccattaaagacgaagatgggaatgaaaaacagatcactcacggcaactttattaatttcttggaaagtgaaaaccgtgaagtccgcaaaaatgcgtttgacgcagtgtataaaacgtacggacaatataaaaacacaatggccacgacgctaagcggcactgtgaaaaaggacaacttctacgcgagagtgaaaaagtacaagtccgcgcgtgaggctgcgctttctaacaacagtattcctgaggaagtatacgataaccttgttaagacgattaataagcatttgccgctcctgcaccgctatattgcgctaagaaagaaagtgcttgagcttgatgaagtgcatatctatgacctgtatacaccgcttgtgaaagatgcggggatgaaggtgacatacgaggaagccaaagattacatgctgaaaggcctcgcacctttaggggaagaatatgcctctatcctaaaagaaggactggaaaaccgctgggtggacgtttacgaaaataaaggcaaacgcaatggggcttattcatcaggagcttacggcacgaatccgtatattttgatgaactggcataataacgtcaataatctctttacgctcgtgcacgagtttggacattccgtacacagctactatacgagaaagcaccagccttatccatacggcaattacagtatctttgtcgcggaagttgcctctacgacaaatgaagcgctccttggcgaatatttgctgaacaatttagaggatgaaaaacagcgcttatatattctcaaccatatgcttgagggcttcaggggaacggttttcagacaaacgatgttcgctgaatttgaacatctgatccatacaaaggcgcaagaaggcgagccgcttacacctgagcttctgacaaatgtctattacgacctgaataaaaagtattttggagacggcatggtgattgataaggaaatcggccttgaatggtcgcgtattccgcacttctattacaattactatgtgtatcagtatgcgacagggtacagcgctgcccaagcattaagcagccagattttgaaggaaggaaagccggcggttgaccgttatattgacttcctgaaagcgggaagctcacaatacccgattgatgtcctgaaaaaagcgggtgttgatatgacgtctccagagccaatcgaagccgcgtgcaaaatgtttgaagaaaaacttgatgaaatggaagagctgctgatgaaagtcaagcagtcttaaaaaagtaagcctgtgcggaaatgacgcacaggcttttttaaaaccctttaaaggtttttcggtgattcaagcggtagagggtaaacaaaatagacagaaacagcagaggagaggtaatataaagcggcagcatatgcatcatgcctaagatattcaagcagaaaaaaacagcaatgcacacaattgagatcaaagtagacatcatggcggtcctcctcgtcctttttccttataaggatatgagtgaatgcacttcgttatgttttgtgacaaaaatatgaacattaagcatagaggttgtcaaaagtcgacatcttttgttatcataaggatgtgaaattgatcacaaacaaacattacccctttgtttgaccgtgaaaaatttctcccatcccctttgttgtcgttaagacatatgaaaccgcgcttatcccggcgcggtttctttagtgctaaaaacagaacttatgtttggttcggggcataaaaaaacagcctcaagcatatgcacgcctgcggctatttttcacatgattgatattcatcagaataagtgctgagagacttccaaaacattccgtgtttggcttccactttggcaacctttttagcaaacgccagttttttcatttctttttctacctcttcaaggctcaggtcatatacaagagcaatttccttcgaggcaacgaagcggaaatattcaataaaacattctaaaggcggtgtttccgacggcttcggctcgtcgccaagcatctcaaataaaatttcttcatatacatcatatgagtagctgccaggaactttaagcccttcatcctcatgctgcgtattaaaaaacgtcagtgtcggattaacagaaacatccatctcagcagcaattttcatgtcacattgaagcgccttgaccgcactttgagaatgcagatcttttttgaattcttcaagatcgagacttgtattttcagcaatctccaaaagcacgttttcatccgtaatatttttctttgaaacaaataggctctcctgcatatttctgagaaattgcatgccggcttttcgtccttgcaattcggctgctttaaaagcgagagcagccatataaggcgatgaaagcggctgatcctgttcgaaccagacattgccgtcacatgacatgccagagcggctcgcgatcttttcccatgcttctgcgagaagatgcttttttcgctttttatttaaagcggtaaggcttgcggaagcgataatgcgtaaggtgaaaaaacgtccgtatctgattttcagctttttgatgacgggctctaaggaccagcattcaggacataaagggtctacaaacatataaatttcaagcggtttttttggatgaccgtggcaatgggcgaagtatagctcatgctgatagtttgtcaagatgatcgatcctccgcttccgtttgattcaccatatgccttgctgtcaactccagccggccaaacaaaaactcacgaatttcgccctccagccctacatggtccattgcgtccttcatacagctgagccacgcatcagctctctcgtttgtaattggaaagggaagatgccttgctctgagcataggatggccgtgctcctcagtataaagcggaggcccgcctaaatactgagttaagaattgcttctgtttcctggcggtttctgtcaaatcgcttggaaaaatcggcttcagcaaaggatgagacgcgacacgctcataaaaagtatcaacaagttgcgatagaagttcctctccaatcgcttcataaggtgcgttaaacgattgtcccatgttgactactcctttaaatatggctaataggaatcataaatcctattgcaaaaagtaattttctgtatttcattgtttcatctagatttattttagcaacaaggcatcatttctacaaacaaactgccttttatgcgtttgatgagtcatttcggctgacagccggggtttgtatttcatatcatatcacataaaaatcaggaatgcgtaagatttcactccgcaaaaaaaccagagggggagccctctggttacgcgtaataagctgaagttattttttttacatagttttgcgtttcttggaaaggaggaatgcctccgtatcggtcaacattccccggtccggcgttgtaagccgctaatgccatagacacattgccgccgtatttatccagcatttgttttaaatatttcgttccgccctccacattttgctgcggatcaagcggattggaaacgccaagtgagcttgctgttgacggcatcagctgcatgaggcccatcgcacctgctccgctgaccgcttttgcattaaagcctgattcctgtttgatgacggcacggatcagtttttcatcaacgccatatttatcagcggcttttttaatcgcactgtcaatagaaaagtctcccgaactgatctgatttgcttcatgtttgtttgaagctgaatctgcagcagctgtttcagtgctttctgccgcttttgtgattgaacctgaattgctgctcgtatatgagttaagcccatacgctgaaagcagtgacggcgctgttgtattcgcgctgttcagcatgctgagcgggcttggcgatgaagaaggtgctgattgctgagatgccagaccgtttgtatattggctgagcaaagaactgaaacttgaaagcgggctttccgtattctgattgtccgagctgctgcgtgcattagatatggactgtagtgcctgaagctgaagtaaagctgcccaattcgttacattcacgatgtcattccaccttatatagactttcgtttttcttcataaaaacgcagaattttatttttggtttcgcgctgaggaatgctgaattgctgaagcagcttttcgaaggcttgtctgccctcatgccaatccgccgcctcaaattcaatttcatagtcctctttatttaaatatcggctgtggtctaaaactattaagcctttttctgtttctttttccgcacggtttgttgctaaagatccaaagtattgaatggcatccgtatcgatctgaagcttgtgcagctggtccttcacggggccctcgggaactgaaaatccagcgagatctgatacctctgaaagctgctggtgcgtttccagaagccccacatcagccggctcctttaatgtaaggacatactttccgttttttctgcggatacgaagcgcagcatgtttttgtttcagcgcgaagctgtctgtatcaaaataatgattcttttgatctgtaaaatctttttctgtcagctggagtgccgctgctatgtttttgaattcttgtttggtcagcatgtttttaaattcgatttcaatttcttggctcatgatgctcttcctttccgccctgcaaatcttatttttactattatctctttagatgttaggtttatcaatatcgagctcgatatgataaaatgaatctgtactttgtttaaaaaaggagagcattatgcaaaacagaatcgaaattttgaatgcaacattatcggatgatcagcttcgccttacttgtcagacagaaggaaacgaagcggaacgcaagccgtcaggtcaaatgctagttgattctgaccactttgcttttgtatacatacttgaattagctgattcttttgaatatgtcattataaaggaacatgtatggccggaactgaagcaggcccatgcacaaaaaataccggttgttttagaggcaggaaaccaaacaattgaactggcaggcctgcatgaggagctggaatatcttttagaaaatataaaagataatgcaaactatggagaagaaatggaagaaaaagtgaaacgcgtgtttttatagaaactggttcggaattgggggatgtatgatggatgacaaacaatgggagcgttttttagtgccgtaccgccaggctgtcgaagagttgaaagtgaagctcaaggggatccgcacactatatgaatacgaggacgaccattcaccgatcgaatttgtgaccggacgcgtcaagcctgtggcgagcattcttgaaaaagcgagacggaaaagcataccgctgcatgaaattgaaaccatgcaggacattgctggccttagaatcatgtgccaatttgtcgatgacatccaaatcgtaaaagagatgctttttgccagaaaagatttcaccgttgtggatcagagggattatattgcggaacataaagagagcggataccgatcataccatcttgttgtgctgtaccctttgcagacggtatccggagaaaagcatgttctcgtagaaatacagatccgtacactggcgatgaatttttgggcgaccattgaacattcattgaattataaatacagcggaaacattcctgaaaaagtaaaactaaggcttcagcgcgcttctgaagcggcttcccggcttgatgaagagatgtcggagatcaggggtgaagtacaggaagctcaagctgccttttcaagaaagaaaaaaggaagcgagcaacaataggtaaaggggaagaagagcatgaaatttgccgtatcatcaaaaggagatcaagtttctgatacgctgaaaagcaaaatacaggcgtatttattggattttgatatggaactggatgaaaatgaaccggaaatcgttatttcagtcggaggcgacggaacgcttttgtatgcttttcacagatacagcgaccgcttggacaaaacagcatttgtcggcgttcacacaggtcatctgggtttttatgccgactgggttcctcatgaaattgaaaaacttgttcttgccatcgcgaaaacgccgtatcatacagtcgaatatccgcttctcgaagtcattgtgacctatcacgaaaacgagcgggaagaaagatacttagctttgaatgaatgtacgattaaaagcatcgaaggaagccttgttgctgatgtggaaatcaaagggcagctctttgaaaccttccggggcgacggcctctgcctgtcaactccgtcaggcagcacagcctacaataaggcgctgggcggagcgattatccatccgtctatcagggcaatccagcttgcggaaatggcttcaattaataaccgcgtgttccgtacggtcgggtcacctctgcttctcccatcccatcatgattgcatgattaaaccgagaaacgaagttgactttcaagtgacgattgaccacttaacccttctccataaggatgtaaagtcgatccgctgccaagttgcatccgaaaaagtgcggtttgcgagattccgtccgtttccattttggaaaagagtccaggattcgtttattggaaaaggtgaatagaaagaggacatatcgtggagcatttttttatcagaaagaacattacttccgctgaggacgggatgactgtaaaggaatatgccagtgaactgggaatttcaaaacgtctgctgaccgatattaagtttggcgggggcgacctgcagattaacggtgagcatgtgacggtcaaatacgttttgaaagagggagatcttcttatcgtgaagtttcctgaggagcaggtgagcgagacgctgttggcagagcctgttccgctcgatatcctttatgaggatgaacatgtgcttgtgataaacaagcagccgtatgtgtcatcaatcccttcgagagagcacccctccggcagcattgccaatggaattattgatcattatcaaacaaccggagtgagggcgacagttcatcttgtcacccggttagaccgggatacatcaggtgtcatgcttgttgccaagcatcgatttgcccactccattttatcgtctgcgcaaaaaaacggccttgtgaaacgccggtatgcggcagtggttcacgggcggatggcacagatggagggaacagtcgatgctccgattggcagacatcctgacagtataattgaacggacggtaacaccggacggccagaaggctgttactcatttttacgtcacatgtgcaaatgacgacatgacctcggtgacgttgcagcttgagactggacgaacccatcaaattcgtgttcatatgagttatctcgggcacccgttgtgcggcgatacactgtacggcggaacgagacaggaaattggccggcaggctctgcacagcgagcatctttcgtttatccatccgctgacacagaagaacatgacgtttcatgctccactgcctcaggacatgagaaaactgataaaaggagagaatcattgattctctccttttttatatggggcgaaatcttgattcgtcgtaaggcagggagcttggaacagagacggtttctatttctggaaagcgaaagcctgtcagttgatttccgaacacgcagcctgtatcaatgttgatggtgcgattgaccttccgaggctctttcacaggtgtatgaccgtataccacccaagcctttccgttataggctgccgcccaatcacgtctgacgggtctgccgtccggatatgtttcacccgtcacgtcaccgtaaagcacaaagtccttcactctgcgggtatatttgccgatatcgtcagctcttatgccagcatgggcgacaactaattctccattatgtaagatgtcgtaaagcggcgctgtttcgtacagcttcataaactgttcgctgactgcttttctctcatccttggaaagttcctcaagctctgccgctgttgtttcgagaccatgcatcacttttaccggatttccttttaagtaacgatataatttattgcaatggtttcccgggacataacgcacagcgcctttttcgtaagcgccggctacaaatcggatgacctctatcgatttgggccctctgtcagttaaatctccggcaaaaacaagcaccctgccttcttcatggacaggtactccatttttgattgtatagccaagcttttggattaatgcagtcatttcgtcatagcagccatgaatatcgctgatgatatcgtaagccatgcggtatcctccttaccgattgttttatttattatgaagcaaagtgttgtgagtcatcacaagcttttatgtgcaaattatagaagaagaatcattttctaaacaggattaagaccttatcactttatttttcatcatcacccttgttaaaatcgcgttatgttttttaaaaatgaggttttgttctctgagtgtgagaactagcataaccctgacttaaaaaggaggttctgattatggcgcatacatctgtcgcatctttagttgttgtacttatcgttgcatttttgacacccatccttttgcatcggtttaaactcagcatcccggttgttgttgctgaaatcattatggggctgataattgggaaaagcggccttaatttagttgtggagggtgacacctggctccagacactctctatgctcggatttatctttttaatgtttttaagcgggcttgaaattgatttttcgtcgtttgagaaaggaaagaaaaagcagttcctgccgaatggcaaggaagcgccgaatacgtttgctgcggcatctgttattttcgtcggtatttttattttatcattgctcttgtcctatgggttcgtcttggccggatttatccaaaatgcatttttgatgaccctgattatttcaacgatttcattaggcgttgtcgttccaacattaaaagaagaacggatcatgaattcgaatatcgggcagattattttgcttgttgctgttattgctgatttggccacgatgattcttcttgctgttttttcttctttatacggagaggacagcggaaacatgtggctcctgatgattctgtttgcggccggagtggtgctttactttttcggccgggtcttcaaacatcgctcttttgttcaatccatgtcaaaagggacgatccagatcgggacgcgtgccatttttacgttaattattgtactcgttgccctgtctgaatcacttggggcggaaaatattctcggcgctttcttagcgggggttctcgtttccctgctttcgccaaacaaagaacttgttcagcagctggactcatttggttatgggttcttaataccgattttctttgtgatggtcggtgtgaagcttgatatttggactctttttcaggataaaacaattttaatcatgattccgctcctgctgctggcgctgttagtcagcaaaatcattcctgtcatgtacttaaagaagtggtatgataaccgaaccattttcgcgtctggtttcctgctgacatcaacgctttcgctcgtgattgccgctgcaacaatcggccagcagcttcacgtgatcagtgcaaatatgtcaggagcgctaattttagtagccgtcattgcaagtatttttacgccgatctgttttaaaaaattatacaaacgggaagagcagccggaggagaaaaagacgattacgttcattggcgccaatcaaatgactttgcctgttacacttgaattgccagaggaagagtatgacgtgcgtgttgtacacgtctaccaagagaatgcggaggaaaagctgtcagaatcagtgtttgctgttgaaacaatttctgactatgaacacgagacgcttgaatcactcggcatttttgaaacggatatcctcgttgtggcgacaggaaatgaagatatgaatgcagacattgcattacttgcaaaagaaaaaggcacagaaagagtcattgcaagcgtaggatcaccggagcatgaagcagctctgaaggagcagggaatcagcatcttttctattctgctgtcgacaaaaacgctgcttcgcgcactgattgaagcgcctggcgtcatgaagctgctcacgaaccaagagtcttcgctgtatcaaattaatatggagaacagtaaatatgatggtgtcattttacgggaattccctttaacaggtgacgtcatctttgtcaggatcttcagaggtgtggacagcatcgttcctcatggggatacaaggctgaaacttggagaccgtttaattgtcaccggatctcgggggtacgtaacggatcttaagaaaacattggaaggataaatcttgaccaaataaggattcgtgttaatatagaggtgcagaacaattcaatatgtattcgtttaaccactaggggtgtccttcataagggctgagataaaagtgtgacttttagaccctcataacttgaacaggttcagacctgcgtagggaagtggagcggtatttgtgttattttactatgccaattccaaaccacttttccttgcgggaaagtggtttttttattttcagagggggaatgatttgtgaagttttcagaagaatgccgcagtgcagccgcagaatggtgggaggggagctttgtccatccgttcgttcaaggaatcggtgacggaacgcttccgattgaccgttttaaatactacgtacttcaggattcctattatttaacgcattttgcaaaggtgcagtcatttggcgccgcttatgcgaaggatctttatacaacggggcggatggcaagccatgcccaaggtacatatgaggcggaaatggcgcttcatcgggagtttgccgagctgttggaaatcagcgaggaagagcgtaaggcgtttaagccgtctcctactgcgtattcttatacatcccatatgtaccgttcggttttgagcgggaatttcgcagaaatcttagcggccttgctgccatgctattggctctattacgaggttggtgagaaattgctgcattgtgatccggggcatccaatttatcagaagtggattgggacgtacggcggtgactggtttagacaacaggttgaggagcaaatcaaccgctttgatgagctggcggaaaacagcacggaggaagtgcgtgccaagatgaaagagaattttgtcatctccagctactatgaatatcaattttggggaatggcctatcgaaaagaaggctggtctgacagcgccataaaagaggtggaggaatgtggagcttcacgccataacggatgacagcaagccggtagaagagctagcgagaatcatcattacgattcagaatgaagttgattttattcatattcgggaacgttcaaaatcggcggcagatattttgaaactgctcgagcttatttttgaaggcggtatagataaacgaaaactggtgatgaacgggcgcgtggatattgcgcttttctctactattcaccgcgtgcagctgccaagcggcagcttttcaccgaagcaggtcagagccagatttccacaccttcatatcgggaggtcggtgcattcacttgaggaagcggttcaagcagaaaaggaagacgcggactacgtgctgttcggccatgtgtttgaaacggattgcaaaaagggtcttgaaggcagaggagtatctttgctgtcagatatcaaacagcggatttccatcccggttatagccatcggggggatgacgccggacaggttaagagacgtaaaacaagcaggggcagacggcattgctgttatgtcaggaattttctcttccgctgagcccttggaagcagccagacgatattcccgcaagctaaaggagatgcgctatgaaaaggcattatgaagcagtggtgattggaggcggaattatcggttccgcgattgcttattatttggcaaaggaaaacaaaagcaccgcattgtttgaaagcggaacaatgggcggcagaacgacaagtgccgctgccggaatgctgggcgcccatgccgaatgcgaggaacgtgacgcgttttttgatttcgctatgcacagtcagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgttcatcaagacccctagcggagacgtatgggctaatcatgttgtcgttgccagcggggtgtggagcggaatgttttttaaacagcttggactgaacaatgcttttctccctgtaaaaggggagtgcctgtccgtttggaatgatgatatcccgctgacaaaaacgctttaccatgatcactgctatatcgtaccgagaaaaagcggaagactggttgtcggcgcgacaatgaagccgggggactggagtgaaacaccggatcttggcggattggaatctgttatgaaaaaagcaaaaacgatgctgccggctatacagaatatgaaggtggatcgtttttgggcgggactccgtccgggaacaaaggatggaaaaccgtacatcggcagacatcctgaggacagccgtattttatttgcggctggccatttcagaaacgggatcctgcttgctcccgcaacgggcgctttgatcagtgatctcatcatgaataaagaggtcaaccaagactggctgcacgcattccgaattgatcgcaaggaggcggttcagatatgatgctacagctgaacggtaaagacgtgaagtgggaaaaagacacaggtacaattcaagacctgctggcgtcgtatcagcttgaaaataaaatcgttatcgtggaaagaaataaagaaataatcgggaaagaacgctatcacgaggttgagctttgtgatcgtgatgtcattgaaattgtccattttgtaggaggcggatgagcatgttaacaattggcggaaaatcatttcaatcaagattgctgctgggcacggggaaatacccatcgtttgacattcaaaaggaagcagtagctgtttctgagtctgatattttaacatttgctgtaaggagaatgaacatctttgaagcatctcagccgaattttctggaacagcttgatttatccaaatatacgcttttgccgaatacagcgggcgccagcactgctgaagaagcggttcggattgcaaggctggcaaaagcgtcaggcctttgtgacatgattaaagttgaagtcatcggatgcagccgttccttgctgcctgaccctgttgagacattaaaagcgtctgaacagcttcttgaagaaggctttattgtgctcccgtacacgtcggatgacgttgtgctggcgagaaagctggaagagctcggcgttcatgccatcatgccgggtgcatctccgattggatcgggacaaggaatcttaaatcctttgaatctgtcatttattattgaacaggcgaaagtgccggtcatcgtggatgcgggaatcggctcgcctaaagatgcggcatacgcaatggagcttggagcggatggcgtactgctcaatacggctgtatcgggcgctgacgatcctgtgaaaatggctcgtgccatgaagctcgcggtggaagcaggacgcctttcttatgaggcgggccgaatcccgcttaagcaatacggaacggcaagcagtccgggagaaggtcttcctgtatgacaggcaggtattcaaggcaggagctgtttgctccgatcggcccatccggccagaaaaaattgaaagaagcgcgcgccgtgattatcggcgccggcgcgctcggaacagccagtgcagaaatgctggtgagagcgggagtcggctctgtgaaaattgccgacagagattatgttgaatggagcaacctccagcgccagcagctttatacagaagatgatgtcaaaaaagaaatgccgaaagcagccgctgcggagcgccgtctccgttcgattaacagcgatgttgatgtgaccggccttgtcatggatgtgacagcagaaaatatcttcgagctgattagggatgcatcaattatagtggatgcggctgataattttgaaacccgcctgatcgtaaatgatgctgcggtaaaggaagggattccttttctttacggtgcctgtgtagggagctacggcctcacctttaccgtggtgccgggttctactccttgcctgcattgcttgctcgatgcacttccgattggcggagcaacatgtgatacagctggcatcatcagtccggctgttttgcaggtagcagtctttcaggtaacagatgcactgaagctgctgacgggagaggagtgcgagccggtgctgcgctcctttgatttgtggaaaaatgagcggtcagaagtgagagcggccagtctcaaacatgacgcatgcccaagctgcggcacaaaggattttccgtttttgtcatatgaaaatcaaacaaaagcggctgtattgtgcggcaggaacacggtgcagatcagatcatctattacgaaagaagcggatcttgaagcgcttgccggtcagctgaggcaggccgggcttgaagtagctgcgaacccgtatttaatttcctgccgctcggatgatatgaaaatggtgctgttccgggacggcagagctttgatccatggaacaaatgatattgcccgggcaaaatccatttatcataaatggatcgggtaataaaaggagtgtagtgtaatgagtatatataaagcattgacaatcgccggatcagattcaggcggcggcgcagggatacaggctgatattaaaacctttcaagagcttgatgtattcggaatgtctgcgattacagcggtaaccgctcaaaatacgcttggcgttcatggggtgcatccgctgactgtagaggcgttgagacagcaaattgacgctgttgctgaggatttgagaccggatgcagtcaaaacgggaatgctctggaatgccgacatgattgaagaagtggcaagaaaaattgacgagtacggattcaatcgtgtaattgttgatccggttatgatcgcaaagggcggggcatccttgctgcgtgatgagtcagttgccaccttaaaggagttgctcattccaagaagctacgcgattacgccgaatgtcccggaagcagaaacgctgacaggaatgacaatcagctcgctggatgaccggaaaaaagcagcggagcagctcgtcaagatgggtgcgcagcatgtcattatcaaaggcgggcaccagcctgaggacaatcacattactgaccttctttttgatggcagcatgtttatgcaaatcacccatccttatatcaatacgaagcatacgcatggcacaggctgcacctttgctgcggctttaacggcccaaacggctaaaggagacagcatccatcaggcatttgaggttgcggccaactttgtccgtgaagcggtggaaaatacgctcggcatcggatcgggacacgggccgacaaaccatttcgcttttaaacgaaacagcttaaatacaagccgatgagatcaccagctgatggtgatctcttttgcgtttgctacggtatgcgcttttcatctggacaaggttatgatatgataggaattaagatcaggtactaatactatgtctttattaaatataggaggctttatacatatgaatttttcacttgaaggccgcaacattgttgtgatgggggtagccaacaaacgcagcatcgcctggggcattgcgcgttctttacatgaagcgggtgcacgtttgattttcacatacgctggtgaacgcctggagaaatctgttcacgagcttgctggaacattagaccgcaacgattccatcatcctcccttgcgatgttacaaacgacgcagaaatcgaaacttgcttcgcaagcattaaggagcaggtcggtgtaatccacggtatcgcgcattgtatcgcgtttgccaacaaggaagagcttgtcggcgaatacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgtcatgggtgtagcgaaagcttctcttgatgcaagtgtgaaatatttagctgctgacctaggaaaagaaaatatccgcgttaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattcaggtttccatatcactgcccgctaagcaggatctatatcaagcaatcccgattagggattgcttttttatttcttctgattttcagctttctgtcatatagatagaatatgacacaatcggagggatgaagatgtctaataagaaaagaaacgcggataaaaaaccgctcatgtatattgttcagccggattatgcagaaaccacaaggtcatccatgcaggagattgtcatcaaaagaaaggccgacaaacccgctccgccaaaagctgaggaaaagccggcttaccatgagaagcagcaggaggaagccgtggcacaggatgtcctgcaagaagaccaaaagcctgcagccgaaccagtgagtcagcaaacacaagaggcgagagagccagagaacataaaaagccaagaggaacagaaagcagagccgcaggccgtagaagaaaccgttgaacacgagcccccgaaagcagaaaaaaaggaagagcctgcacttgagacccggaagcctgagaaagaaccggaagctgtccatagtgctgataaagcggaggaaaaagcaccgccggcacgaaaagtgaaaaaaccgatgagcaagatgacgatccacgaaaaaattgattttttaacaaagctgcctcataacatgccgagagcgctttgtttgattgaagccaatggaagaacgtacaggggcgtgattgtcggaagaagaaatgattccgtcctgcttcgaacaaccggaaacggagccccaaccgagctggcaatcgatgatattacctctctgcacccgctcggtttttaacgaaaaagaaaaaagctgcccggctgatgttgccggacagctttttttacatagagaaaagcctgcaggcctgcaagcttttccagcttatgattaatgatgatgtgtacgattgattaatcgaggatttaagcagttgattgcgcagaagcagtctaagtcaacttcaatacagtagttcgttttttcgagtcggaacacttcacacaccgtatctttatcggtgaagtccaaaatgtgtttgtgttcgtcaaatgcgattaataatgacagtgttgcgcagcttccatgcactctttcgaccctgaaaaatactgtattaaagcaagggccgttatcgagttcgccgacatttccgaaggcgactaatggcgttgattttgatgtaaatattgcaaaaggcactgtgtcgcctaacgaatggcttacagataaaagcttagagtggcagccggtcgggcagtcttcttcaacagcgttttgcagatcttcaatattttctacagcttcacgcacgcagcttgatgttttctggctcatattatccctcctgccttataaatttgagactggcgaaatgatggagagtcagctgcctcacgctggaagcagctgaatgatttgcacctgtaatagagtttggaaggggattcctctttacaagtgtttatccattgtgatgatgctttttatctttgtgaggcgatgttctgtcaactagctctggtgacaggcactgaatcgcgcagaagcatccgagatccacttcaatgcagaaatctgttttttctagcccgaagaaatccgggtcgcaagggtggcaaacacttaaggtatcgcctttgacatcgaccgggcgtaaaatagaaagtgttgcacagcaatcgcataatttttcgacgcggaagaaaatggattcaaagcattgcatatcatccacaaatccccctacgtttccgaatgtggagaacaatccgccttttttatcaaacaagagaaacggaattgtgtctttacctgcaattgtcggattcaaaaggtttgtatagcagccagtcggacactgttcctcaactgcctcctgctctgctaaaatcttttccactgcatcgcatacacagttctcatgccggccatgggtttttccgcagctcattgatttcagctccttctttatagggtatttgactttagtccttaacaacatatgtacccgtgccccacttggtgtgggtgaacgtctatatattcatcatatgcttggaaaataagaaaaagcagagcgtttttagctctgcttttaggtcctagaggacaagagtgataactaggatggctacgagtgtatttgttgctgtagaaataagggttgcgatatcggcatctactgttgtgacgtttacgccgcgggaacattcgatgagaagtttttggcggtttacttgtttgttagctgtaagctgtaacaaatcttgtgcgactaattcggcaattaccccgtctgcaattgatgtcagagttgccgttacgacagcggcattaagtgctgttacaactgatgttacggcttgaacgtctgtagatgtaacattgatgtcacaagaatctctaataataatcgtttcatctgaaacttgtttgttgagatttgcttgagctagatcttggtcgatgaaggcgttgtcgttgccaaaaaaaccattgccattacagcaaacgtcgcaatgacattttctttcgtgtttttctttatctttctctttgtcatctaacggatggtcacagtcaggatcaagtgcaacccaagaatatggtctgctttccatatctattcctccttttcttttactgttattaaatgagcgagcctcttattttgactgagtcatatatcctgatgaagaaccctatttttttatgattggctaattgttatcgtttttccgtctttgtctgatctgttcaatgagctgctctctgcggcttaacggttttgtgttcttttgctcttgcgcggctgcttcttcttttttcttcttttggttttctattagcgcttgtgatttagcttgtaagtcttttacaagatttaagagcatttctttttcttcgtctgatacttttttcattttgtcttttgtgaccccatgtttagaaaatatattttggaccagcattttcgtcattggatcaacttctggaagctttgcaagctcttctttgaatttatcgttatctgacatttgttttcacctcgtcttttaagtttgtgaaaagaaagggttaaaggacgtcaagttcactaagaatgctgtttaacacctgaagcaagatttgtacaaaggttattatctcgtcggcagacaaagtaattttgatgttgcggctgttgataattttaatgatggttctttttttgatttgggagctatcgagaataagaatttcacttgccactgcgtcagccaaatcctcgtcggcgatgacgagctgagtcgccacgataatcatggttgtcacaaaggcttgtatagaaagggcagctgttatatgtgacgtgtcaattgtgatattttcgcaatcaatcacttcgatctgctgttcgaattcgcttgataattgctcaaatattgcagggtgcagggattcgactttttcttcaaatgacataaccttcactcctttcttatccatactctatataatgcaaatggggtgcagagcggaataataaaaataaccaattttctgccggacaagatacaattcatgaagaatagggttttggcatatatgtgaagggatcatgattggcaaaggagtgaacgagtggttataaatgggctgacaattgttcttctatcgcttgcggtctttcggctcgcccgcctgctggtgtttgacacgattatggcgccgcttcgcagtctgtttcatgaagagaaggaagaaaaggatgcggacgggaacattgaaacctatatcgtgattaagggaaccggtgtcagggcgtttattggtgaattgctgagctgctattggtgcacaggcgtgtggtgcgccggctttttgattttatgccaggcgttgatcccgcaagcggcgcagtggctgattttacttttggcgatcgccggccttgccggcatcatagaaacgctcgtatcaaaatggctgcaagaataaggcgttactaccagcaactttctgtcagaatacgcataaagtagcatatatgacataaggaaaggaaggggacaaaaatgaatcagcatcataaaccttcccaaaaatctccatatacagattcatcgtatcaatcaaaaaagataaaaaagaaaggctgcgggtgcggaaataaaaagaaaaagcctcaatagcctggcaaagaaaccggagaactccggttttttgtttttttaacggggcggccttgctcagcatatatcataagcggggggataaaagtgaatgagtttgaaaaatggatagaaggaagatatgaacctcacgaacaaaagcaaaaaaagcatgaagacacgatgggcagtatcagaaaagacttggatgcatttgataaagccggtctggaatttgaagatgagattgaagagctggctgaaaaaacagaggccttacttaaaaaacatcaagctcaatatgatcaatcgtaaatccgcaaacgccctatgcgaatatccaagccgatcccagcagctcacatagtgtatagagagtaaaggaggtgcttatctatgggctttggatacggattcggcggcggctacggcggcggctgttatggcggttatgctggcggttacggcggcggctatggttcaacatttgttttgttggtcgtattattcattctcctcatcatcgtaggtgcatctttcttttaagatgtattgaggaagtacgggttataacccgtgcttccttgccttgtgtttattttttaaaatgttggaaaagcacattgtattatgtgcattcatacaataccgtattattccgccaaaaggaggcgcattatggataatcaattttttaagaacatcgaaaagaaaacaggtgtgaagatgcaggatgtaatgaatcttgccggatcactccaaaacgctaattttaaagatgaaaatacagtgcgcagtgtgattaaccgcgtagcgcagatggcaaacagacgcgtgccaaaagaattagaagataaaattgtggaatctattacaagcggaaaagaaaagcttgattttggcacgatttctaaaatgatggataataaataagtggatggcctggctgactcactgcagcgggcctttttttacagtaaaaacccggcagtaatctgccgggctgttaatgatgcaagggctgtcttgctttctgtagaaggggatacaaaaatcttgagcggttggctgttttgccgcgcctgttagcggggcaagacaaatataaatgctgtttcgcccgggtcatggctacatataaaaggcgtctttcctcctcaagagcggcctcgtctccttttcttgccgtttctaatgagaaatcgtgcggaatcgagccgtctacagtgcctaacacgtagactgttttgaattcaaggccttttgaccggtgaatggtcatcagctgaacgccatgttcatccgttctgtttttctcagcggccctcatatggtctacgtgggcaagaaagtcaggaatcgttttgaacttcttggcgacaaccttgatgtcgcgcaggtcatcggaacctttttccagcttgttgccctcattgccccgcttttttaaatactcggagaagcccatttttccttctgcaaaggtgatggcttctacgggcttcatcgtgcggaggcttgcaaaaaacggtacgattttcttgattttgtccagctggaatggcttcagatcaggcaatttggccagcgctttgatcatggtacagtcctctgtgatcgagagcgccttcagcgtattcaaagcggactgttttaaaaacaaggcgggaagcaagtgtttaatcgcctcggtgtcatcctcattttggctggcgtacaagtaggcgagaatctggcggacgatccgtctgctataaaacgattggacgccgcggtcagctgtatacggaattgacgattgatgaagcctttcatatatagcacggcctccgctgtttgtgcggtaaagaaccgcaaagtcttctggactggctccattttgaattttttctttgatatcggaaacgaccattgtggcttcttcctcttcatcataaggataaaacagcacagggacctgaatgtcatcgcgggccgcttcaagcgttttggcatatctgtttttgttctttttcacaacgatatcagcactagagacgatcgggtgcgtagacctgtagttcgcagttaaatagatcgtcttcgctcccggataatccttttgaaaatcaagaatgaaagacggattgcttccgcgaaacgcgtagatggactggtcatcgtctccgacacagcacaggttttgctccgggctggcgagcatttgcatgattttgtattgaaccggattaatgtcctgaaactcatcaattaagatatacgtaaaccgagattgatattgttccagaaggtcaggccgctcgataaacaattcatagcaggctgaagccatgtcatcaaaatcaaattggctgtgttcttttttctggcgttcataatgttcatataaacgataaacttgtttttcccactcatcttttagagggatgcgttcatttgggacataagtgtttttccaaaaaccgatctgctgcagagcttggtcaactgggaattctttctcatcgatgccttcttcatagagtgcttttttgatatattgttcccgctgccactccattttcagcagatgctcaccgttccatttagcagaattagagtgatacaagatcttataaaacagactgtggaatgttcctgtcacaagtcttctgacttttgccggctgtaatccgtactggttcgccatacgctctttcatttcagcgacagcttttgttgtaaaggtgacaagcagcatattttcaggcggtatgcctaagtgttcgatcatgtgggcggcacgggctgtcagcacccgtgtttttccgctccccgcacctgcaagcacaagcagcgggccctctgtttccgtgacagctttcagctgatccgtgtttaaaccgacagacggaaaaaggctcgtatcgggttctattgtttttggcacaaatggtgttcctggtttaatgcttctaggacggtgccattctgtaacagctggggacgggtcagcggcgatcgcttttcccttgggtaaacgaatgacaccagattcctgatcatcttcttttttcccctctttagagggcttcggttcgcacgcctcctcacatgccggaaaatcgcctggctggcgatggataaactctggcggatcggcgatgttaagccgtaacaaaacgggctttccgcaatgagaacaaaataaatgtccttttattccctcttcaaagaggaattgataatgttctctcgaatatgtatgtaaatgtataattctatcattcagtcgggcgcatttcaaaaaggggtcctcccaatcaaaaggtgttcattacagacaatgactatcatatcaaaagaaatgtgtttcaaaaagtaagtttaagggaaaagagacagcagaggggtgggtattgtatgatatatgcaggtcaaattcagaaccagcaatacgctcaatatgctaatagaacgattggacataagcaggattatgccggaaccgaaaaaatcagctatgtcccgtttcagcgggtatacaaagaactggaaaagcagcaggagaatcaaacggcagctgaaagaaaagtaaacgagatgaaacgtaagcgctctctttataagagattgcgagaaaaaggaatgggcacatatattaatcgatatgtataaaaaaccgttcataccagagaacggtttttttatatgcagtaaaaatccggatctcaaaagatccggatgcgttcagtccttcatcatttgtaagtgcggaatgccggcatcgaggaattctttttcagaaagcacgcgatacccgtgtttcttgtaaaacggcacagcctgtgtttgcgcgtttaaaatgaaaccggaagcgcctccgtctgccgcggctttttcgagcgctttcataatgatgccgccgacaccggctgagcggtggcttttcagtacgcaaatccgctctaacttgccgtagccgtccttcatgcgccatcttccggcaccgactggcttttcaccgtcatacacgacgatatgctctgactcattttcaagttcgtcaatttcttcttcagcaggcacgttttgttctttgacaaagacttcttctcttacatagaatgcatctttcagttgttcttcattttttgcgataactgctttcaaacattattctcctctgcctagcaagaaggtttcatatactgtccacgatccgttttccaactggtaaagcaagtggaaacggtcaacgatttcttcatgcgacacttcctgcatttttaattgtcccagcacatctgaatgctcatcgtcggaaagattttggccgaccgtcacatgcggaacgaaattatattcctgttctcctgccaacacaccggtgtatagcttttcattgagtgtttttaactcttccgtcggttctgctttgatgtaaatgacattattgacaggcgcaaatgagctgtattttgtcattttgagaacgagtgggtgggactcttttgcgatgtttcttaaatgtgatacgagctgatccgctttctcctccgcgcattcaaaggatgctctcagcgtcaaatgaggcgggattagagagtagcttgggtcatagcgctttctgtaagagtttgcaaggtcttggagcttttttgatggaaataaaacgattccgtatttcatattatgtccctcctggaaataaagtatgatagagtgttaaagcatttttttcagcgccggggtgatgagcggctgccagtatgtccatttgtggtctccgtcaaatggctcgaaatcataatcggaaagctttttctccagcagctgtttcagctcccggttcggttctgtaaagtccagaatgttcccgtctgtcgtgtggacgtcagtttcttttgttccgatttggtgataaatagagaggtgtttgatatcgtctgactgttttacggcttctagtacgtgtttgtcaacatagggagactgcatgatgatgttgccaaacatattcggataatcaagcgctgtcataagtgacacggttgctccgagcgaatcaccgatcagcgttcggccgtaaccgatctgataggttggatactcatcatctgcaaaaggaacgagctcatgggcgatgaaccgtttataagccgaaaattttgaaccctccggatgataggtgtttctgcgctcttttacatccttataaggaacaccgataataatgctccggtctatttcgcgtttcgacagcaattcctcaacctgtctgccgatcctccccagcctgaaataatcgtggccgtcctgcgcgataataacatggtatttataaagcggggagtagttggacggcagataaacaagcaaggtcatttcctcgttaagctcttttgaaaagaatttcttttcttgcactgtgccgtttttcggtgccataaaaacattcctccaggacatcactatactttcttgcattttcaattattgtaccatgaattattagaaatttctctctttaaacggttcggcacacgaagaaaaaagtgttgaaataaactgtgaattgcgctaatataaaacaatcagaaaattgaaatcgatatttcttatcgtgagaggtggagggactggcccttagaaacctcagcaaccggcttgttttgcatgtgcaaagcgccaaggtgctaaatccagcaagcgttttttatgcttggaagataagaagaagcgttaaaccccttcttcttatgaagaaggggtttttattttgaaaagggaaggtgtcagctatatgtcacagcacgttgaaacgaaattagcccaaattgggaaccgtagcgatgaagtcacgggaacagtgagtgctcctatttatttatcaacagcataccgccacagagggatcggagaatctaccggatttgattatgtccgcacaaaaaatccgacacgccagcttgttgaagacgccatagctaacttagaaaacggcgcgagagggcttgcctttagttcgggaatggctgctatccaaacgattatggcgctgtttaaaagcggagatgaactgatcgtttcatcggacctatatggcggcacgtaccgtttatttgaaaatgaatggaaaaaatacggattgacttttcattatgatgatttcagcgatgaggactgtttacgctctaagattacgccgaatacaaaagcggtgtttgtggaaacgccgacaaaccccctcatgcaggaggcggacattgaacatattgcccggattacaaaggagcacggtcttctgctgatcgtagataatacattttatacaccggtcttgcagcggccgcttgagctgggagctgacattgtcattcacagcgcaaccaagtatttaggcgggcataacgatctgcttgctggacttgtcgtggtgaaggatgagcagctcggagaggaaatgtttcagcatcaaaatgcaatcggcgccgtcctgccgccatttgattcgtggcttctgatgagaggaatgaagacgctgagcctcagaatgcgccagcatcaggcaaacgcgcaggagcttgcggcgtttttagaagagcaggaagaaatttcggatgtgctgtatcccggaaaaggcggcatgctgtccttccgtctgcaaaaagaagaatgggtcaatccgtttttaaaagcgctgaagaccatttgttttgcagaaagcctcggcggggtggaaagctttattacataccctgcgacacagacgcacatggatattcctgaagagatccgcatcgcaaacggggtgtgcaatcggttgctgcgcttttctgtcggtattgaacatgcggaagatttaaaagaggatctaaaacaggcattatgtcaggtcaaagagggagctgtttcttttgagtaaacacaattggacgctggaaacccagctcgtgcacaatccatttaaaacagacggcggaaccggggcggtcagtgtaccgattcagcacgcctcgacttttcaccaatcttcatttgaagagttcggggcatatgattacagccgctctggcacgccgacaagaacagctctcgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgacccggtttggcattgagcatacgtttgtcgacatgacggatcgtaatgaagtggcgcggagcatcaagccgaatacaaaggtcatttatatggagacgccatcaaatccgacacttgggattacggatattaaagcgattgttcagcttgcaaaagaaaacggctgtctgacctttctggacaatacattcatgacaccggcactgcagcgtccgcttgacctcggcgtggatattgtacttcacagcgcgacaaaattcttaagcggacacagcgatgtgctctcaggtttggctgctgtcaaagatgaagagcttgggaagcagctgtataagctacaaaacgcgttcggcgccgtccttggcgtacaggattgctggcttgtcctgcgcggattaaaaacattgcaggtccgtttagagaaggcgagtcaaacagcccagcggcttgcggaatttttccagaagcatccggcggtgaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactcccagtcttcgctgtcagccttggcgccgtggaatcgattttgtcctatccggcaacgatgtctcacgcggcaatgcctaaggaagagcgtgaaaaacgcggtatcactgatggcctgctccgtctgagtgtgggcgtcgaacatgcagacgatttagaacacgatttcgaacaagcgctgaaagaaattgctccagttgcggttcgttaaaaaagaagccggggatggcccggcttcttttattattgttcgtcatcaggattcagaatcgcgaggacttgatgatcctcccaaacgccattaatttttacattttttcgggcgatgccttctttatgaaatcccgctttttctaaaacacgcatggacccgagattacggggcatcacaccggcttcaatccgatgcagtttcaattcgtggaacgcataatcaacaaccaatctgactgcctctgtcataatgccctttccattatgggctttgtctaaaaaatacccgatgaacgcagtttgcagcgcgccacggatgatttgaaagagcgaaaccgtcccgattaatctatcgtctggcgctgtaaagatgccaaaatgatattcttcatctttctcaagtctttcctgatactcggttatccgtttgctttgcccctcaaccgtatagtaatcgtctgcgcgtatcatagaaaactgttcgaaaaaatctcgattttcactttgcagccgcaggttttcttcggcatccgttacttctaaaggtctaacataaatggtttttccttttaacatacagtgatctctccgttctcgtgtcagcattcctcttacattattctcagggaaatgcaaatatcctttttataagaaggaagaaaaccaatttcccataaaagtgccaacatagttgccgattaagtagccgagcgtaccgacaagcatgatcggggcgacaagctcccgccatcccttggcaattgccatcgcagccgcagtcgtcggtcccccgacagtagcgttgacggcgagcagaatttcttcaagccgcacgcggaacaattttccggcagctaaggaaaccgctaaattgctaatcgcaatgataaacacgaataatagaataaggggggcattcgtgacgattaaacggagatctgcaggaatgccgatcaccacaaaaaacaaataaatcaaaaaggttccaagttcctgagatccattgagcctttcaaaaaaacgcgggaaaagaaaaatgataagaacagttaaagacgtaagcaccaggtactgatcgccaagcgtaccggtcagcaggggatgagaaaaaatgcttttaaaataaccggaaaccttcatactaaccgcaacaagcgcgaaagcggcaccggcattaaaagcgatatcctttaaggaaatatccttccgtttccaatagctttcagcactgtttccgcagtttccatcggcttttaccttctcttcaaacggcatggcataatgccgctgaaaccatttgagtgcaggaatgctgattaaaataaaaaacaaaagcgccatcataaaattatcagccacaacggtagccgacacatattcaccaggcgtctcaaattttgccgccatcgccgcaaagttgaccccgccgccgatataagaggcgctgatcatcccaccgattttatcgagatagggaatatgctgtttaagtagaaaaaaagcaagaatgctcccaagcacagtgccagcggagctaatcagaaaaataaacagcaaacgcctgctttccttaaaaatttgccgaacattgatctgaaacaataaaagtggtatcgccagtggtaccacataagaccacacagtgtcatacacaggcgactcaacaggaagcactcctacatttgtaaacaccatagcacctgcaagggcgataatagcgcccgacacagcggacgcccacttaaagcgctgctccagcccgatactcactgccgcccacaccgcaataaacccccataatacccatacatcatcggaagaaatcaaagaatgcaaaaccccatcacctctattgttagaaaattaagacatattataatagccgatgaacagaacagcaagtccgaaaaaagtttttctgaaaaagcagttgacgaatagaggaggaggttatataatagaacttgtcagaaagacaacaacatacccagtaacacatacatatcatgattccgtagctcagctgggagagcgctaccttgacagggtagaggtcgctggttcgagcccagtcggaatcatagcttaaacccttgcgtagcaagggttttttactttacttatttattgattttgtcatcattcatcgagttgggaccgaattgggggcgaaattatttttttgagttgattttgaagaagaatttcaaaatcaactctgtttttgtgctaggtttctaggatcgaactggttaaattgttttactgtgctattttcgagtttctcggtaacgtggccataaatatcactagttgttcgagcactggcatgtccagctcttctttggatagcaactgagactttcgccagcttccatgaggagagccaccatagtatgccaaaataaaacaataataataaataaagaataatgtgtttgttatgtaattattttttgcttcagttgataataaaaaaatagcaatacttttgcttaaaggaatgtcaatcattctccccattcggagatttgcgacttttttctttttctttcaaatacttaataaaatcgatagcttgtcttcgtgcttcttctgaaaaatcagatgcatctttaaaggcgatttgtaaatcaggatcttcgaataagtcactattaaagctgttaggtcttttgcctgtaagaatataatcagtagttacgccatataaattggcaattttcacaagcatttcaccatcaggctttcgcaaaccatattcccagtttgcataagttgacatggttttaagacctaatttctttgcaactagagatttgctccaaccctttttttctcgtaattcggttaagactttccctgttatattatccatatttatacaccttttttcatttggtgtgtaaattttaacacgttttacacaagataaataaatagttacacaaaaagaataaaaatatgttgacttacccaccgtgtgtatattatgatgagatcaacaaatgttacacatatagagtaaggtggtggaaagatattatgcttagaaaacttcgagatacaagactcgctcaaggaaaaactcagtcttacatggcgaaacaacctggttatagatatgctagcggctatgccaacatagaaatgggtcgcacaaaacccagccttgagaaagcccaacaaatttctgagctcctagatggtgatgtaaatgaactttttttgatgaaaagttacacgaaaagagtaaaaccgcagcgtaggaggtgtagaaatgtctcgcaacacaatgaccgtgcaggaagctgctgaatacatcggtgttcatcatgacacgatttacacaatggttcgtgaaaaagaaattcctcacttctgagtgcgcacacgtattttccccactaagcacagcatagatgcgtggattgaagcgcaggaacaagcaaatatgaaacaagcgcaatagcaaggaacctactgaacgaaaattttcgtttagtgaatgacaactttttctaaggaggttcatgaatgaacgaattacaaaaagtattcaattatcaagatcagtaggttcggacagttggaaaggatggacaaccttggtttgtcgcaaaggatgtctgcaatgtactaagtcattcaaatcacaaagtagcagtgtcccggctcgacgaagacgaggtaagtaaagtttacctcaccgattcattaggccgtaatcaaaaaacaacagttgtcaatgaagctggtttgtattcacttattttgactagtaacaaaccagaggctaaacaattcaaaaggtggatcactcatgaagtcatcccgcaatcagaaaaacgggcggctacgttgcaaatgacgagttattcatccaaacatacttgccgcaagctgatgaaaatacaaagctgcttttcaaaacaactcttcacactatgaaagagcaaagcaaacaaaaggttaatgtcgagcaagtgcctatgatcgttgctcaggctgatgatctgaaaatgataggcaatgacgcaattattgcaaaaagagacaagacaaacggttggctcaatggggcgatggttttattctttgtaatcgcagtttttccggggatagggggttaaggtatggcgacaactgagcaaataatacgcatgaacgatattaatggtctgataaagctaatcgcaagcacagacagacgcactttctactgaaatactagacacaaacaaaaggagggaaataatgagggaccccttagcttatataaacagtgcaaaaatcctttgctctttcccagtcagatataagaaagacatgaagacgtggattcaaggtgtttcaattaatgaagaaagacaagagatttatgtagccaatcaagaaaacacaggaacagtacttcgtattgatgtacgggaccttaatggtaaacttaagagtagtaaaaatatcccgattgatagtgggtcttttacagaatctctaccttacttctataataagaacgatcaactaagttttatcgtacgacccaaaaatgaagaatctgcggctatattcaactatgaaactggtgtcttagggagcacctttcctattaaaggaaaagcaaaatctgacgttgatggggattactttgtcacatctgatgtatggactgacactattaaaaatatatacatttacacttgggagagtgtaaaagcaggaaaccctgtactggttaatagtattaggacagagaactatggcagattaactgaaaaatctcagggtattgttgtgaacaatggttatatcttcataacgcaaggtgctcaaaaaggaaaacctgccatcactgtatacaacacagcaggacaattagtaaattccttcatctatactaaaagtagtcttgcaaaagctgtcaatagtaaattcctcggacggctaccagatgcagttaactatgactacgaaaacgagggcggatgcaagtacaaagggagactatccttagctcagatcattgacggagaatgctttatttttgttcataattcccctagaggcgttgcgttagaaacagaaatcccaatctataaagtagatactggctacttaaacgtaactctgttaaacgggtgtaagacatatggcgctgacactgtgccaagaataagaagaatcggcaatctggtagagctaaatggagcactaaaaaatgtatccaaccttaatacagaataccttgagtttcctaaggaattagctcctgatcgtaacatacagatggtgcaggttaccagttcaggataccagtgtaactggcaagttcagccaaatggcagagtcaaaattattaataccaggaatcctaatacagggtcaggtacatggtacccattcatgttccattggtccatataaaatatagcattttattaagtggttcgggacggtgggttccacgttcaattatggggatgctcggttgcacttttattgttgagtattattttgatcgtcacaattatcggcatcttgccttgacttggcctcggcgccattagcgtatttcttcttttaggagccttcgttggtggtaagcgcttagaatgtccgcaatgtgaatttaagaacaactttgtcatgtatggagaacataacgtaacttgccgtaagtgtaagcagaatatagcgatagattggatgcggaaaaaataaaagccctagccttattgggactgaccccataagatgagacaaataaaaacaccttcaagaattgaatacggatgattgttatccgaaattagacttggaggtgttttttctatggggacaagagtgagttatccggtagaagtgaaacagaaggctgtagaaatgagattggcaggtgtacctatgaaagagattatgcaggagttgaatattaagaataagacacagattcagacatgggttagatggcataagactggggatacacatcgatttgaacagcctgttggaaagcaatacgcttatggaaaaggtccggagtattcttccgaattagagaaactgcaggcagagattcgtcacctgagacaacagaatgaagttttaaaaaagtacaacgaattggaaaggaagttgatagcgaaacatcagtcgaaattgtagaaatgttgcacagcacaatgaccgtgcaggatatctgtattcatgtaggtatcgctcgagcgtcttattatcgttagaagaagaatctaatgaaggatcatcccaagcgctatttggaaaacaaatcggcacgttgtgtcgagagccaagtatcgatatggatatcgaaaaatcacagccatactaaaaaagagaatgtgtattaaccataaaacggttcaacgtattatgcagaaaaatcagtggcagtgccgggttaaggtgaaaaagcgtaagaagaatgggcagccatatgccgtggtcgataatatattggatcagaactttaagtctgatcgccttcttgaaaaactagtaacggacatcacatatttgccttatgaacagaaacaattgtacctttccagtatattgtgaatttatacaatggagaagtgattgcttttacgattggggataagcaggacacagactttgtattagacacacttgatcagctaccaacgctgcctgagaactgcgtgttatatagtgaccaaggttctgtgtatacatcttacgagtatcaaaaagctgttaaaacaaaaggcattaccatgagcatgtcccgcaaagagaagctcgctgataatgcctccatcgaatcgtttcattcctcagtaaagtctgaaacgttctatcttaacagcattgatcgaactacgaccgccatcgtagaacgcactgtcataaagtacattcattattataacaatattcgtattcaaaccaaactaaacaaccaatcaccgataagctatcggcaattggctttaaaaggtgttttgattcctgtctcaaaaacgggggtcagtccctattgggtagagcttttttcttttaatatacttcattctcgccgatcttctcagcggctacatacaccatttcatctttatgatgaaaactcccttatgcgttcttatttcgaaagctgtttaaataagtcgagccagttcttcttatagcgagcataactaaatcgtttgtatacatctaacgaatttttggcaaactttttctgcagcttactgtctttcattaattcgatcactttttctgcagcttcttcatagttattatattctactaagtacccatctttcccatctctaatgagtgtttccggaccgtacttcgttctgtaactcactacgggcgtttgattggctagactttccataattactaagcagaatccttcgaatcgagatgtcataatagacagcccgtgtttttgaatttctctattaacgttatgagtaaacccatgtatatgaacgttattttctaaatgcagatcctttatcaacgcttgtaaattttccttctcttttccataaccaaagatatgatactcggcgtctttaatttcgtcgaccacaatacggaaagcacgaattccgtccgcaatatttttactgtcctccaagcgagctagtgttatggccgatttagggtttcgttcaatagacttatctaatatcgcgcctttatctagagtaacagcatgaggaattacaacaaatcgctcatccgttccgtaatcttcctcaacatctcttttttgctcttcagttaagaaaacaatcgcatcgaattcgtctttgtggtcaaatatctctttgtacacgcgtctgtatggagaccctttaacgtgcggtttatcaagatgtgtattatgtagtgttacaattttgtgacaatcgtttcctaccttgcggaaaacatctaataaacctaattcatccagcattaaaaacggattcgtgtaatcctttaggatagactcaacccaatagacgtgtgcatcagttatatgattgaatgccttgttaattccagcatgaagaacacactttgttcgtttccctgaagagtttacccaaacagataaataacaatttccattaatgtcatagtatttttcaaacgcgggcttgttgttctgaagattatatctaatctcacgtctttttctgccattaagatcatattcaactctatgagtacgttgaagattaaggtcacggtaatcaatgaacttaagtctcattttttcgtcgaacagcttgtactttacgtagttgccttctttatcatagtatctgtagccgtttgtattaggacgatcgtcgtctatatagtgggagaagccatcctcgaacaactcaacctctggagaactaacgttatcggaaaggtgcccagggaggttgtagaagtgctcgtgaaaattgtatacctctatattctccgcaagcctctgtctttttttcatcttcgagattatatgcgcatgattattttgaaaattaagagtaagaaatgatacagcccctctttcagtagcgaccatattggcgcgtctttcagttgcaagagccattccggatctaacttcgtctaagaaatcaataagtataaaattgtggttcataaaactctccttaataatttattaattccattatatattaaattcataggtaggtgttagtcgcattacctaatattctctatttcgataatttcccgaatatcatcgatctcaaatgtatttacaattcgctctaaatgatcgattgaaatacggaccacgtgatttcgagaaagttgtgaaatcgctgcaggtctgataccgactttttcggcgaattccccttggtttagtccatatcgatccattagcatgtcaattcgaagaactactcgtctcactactacgcctccattcgttttatttaattatagtacaaaacttcattttcgcaaaagcgtaatttgttattgacgattaattcgcgtatgagtaaaagacgtattaacaaatatacgtaaaggcggaattgttatgcattacttagcggaacaccaaacgttcgactcgacggatcaacttaacgaatctgtttacgaacatatcaaacgcaatacatacgagcttaacgatacggatcgccgggcgcttaagatgatcgcaaggtacgcggttaagtttaacggagcggctcatcttaaagcggaaacgttggcgggcctgatcgagaaatccgttaagacggcgcggcgggcgctgaataaattagcggggctcggcatcgtaaagaaggttgctactacgcggaagattaacggaggaaaaggcgcgaacatcatcgtgatcctgccggttaataacgctagtgaagccgaggatgaccaatcgacaatgtccaatcgctgacaagccgagaagcctacggagccaacagttgaagcgccgaaaacgaaccatcggatttaattaagcgttctaaaaacaaaaataacgtattagatacggcgactgtactggctgaagcgttaaaaggcgcgctgcctaacgaaatctataacgcaatggctcgctactttgacgcagataaaatttataaatattacggaattcttttgcgcgctaaagcaagtgtagacagaacgatcagactcgaagatcatgcggcgccattcgtagaagcgtggcacgcaacgattatgaaagcgaaatcgcacgaaattagacgtttcgacgactacctatacgctgggtttaggaaggcggcttggacagttaaggtgcgcttaaaccgtggcggatcgcttatggaacgtttcagaaaggcgtttgaataatattgcgggttacggtacgtggacttgcgcggtggcggtgctatacgctatagttcgtaatatcgaaataaaaactgtttgacttaacgatgacttaacgctgatataccaacgtttgacttaccgattgacttatcggatcacttgcggctaccttgacagggtagaggtcgctggttcgagcccagtcggaatcatagcttaaacccttgcgtagcaagggttttttactttgctttaataaaggcggtttatcaaattcggagttgttggcaaacttgatttttggcttcgaattcattaacctgtatagcatcagctcttcagcgccgatggtagtcgggggtttccccctgtgagagtaggacgccgccaagcattacttttatcatcgcggggtggagcagttcggtagctcgtcgggctcataacccgaaggtcgcaggttcaaatcctgcccccgcaaccaaatatatgattaaataaggagtgccctaagggtacaactaaaataatcttatacaaatatggtccggtagttcagttggttagaatgcctgcctgtcacgcaggaggtcgcgggttcgagtcccgtccggaccgccattaatgtaaacgaaacgatcatgttttcgttttttttgtgttttcttttactgtatcttctgcttggtgtcatagccaagctttctttatatcgggaacatcttggatattccagcaaaattcgataaactaggaagagcacatataggcatatgcaggggtgaaaggagattttggttcatggatgaatttgatttgatacatagcattactccgcggaccattcaccattcttccgttgatgtaggaataggtgatgatgcagcgctctacactgcgaaacacggcgttcaggaaattgtttgtgttgatactatggtagaagacgtgcacttcaaattacactattcctcacctgaagatatcgggtataaggcgttagccgttaatataagtgatattgccgcgatgggaggcattccgaaattttatttggtatcacttgcggtaccttcaaaatggactgaatctgaaatcaaggcgatgtatgaaggaatgaatgaactggcgaaactatatcatatggatctgattggcggcgatacagtttctaccgctgacaaattagtcgttacagtcactgtgatcggtgaaattgaaaagggacaggcctgtttgcgcagcttagcaaaaccgaatgatattgtgtttgtaaccggtgaaatcggttcttctgcagcaggactttctttattattagaggagactcatcctcaaaattcttctattgacacggattactttatccacaggcataaacggcctgagccaagagtaagtgtcggcagattatgctcgagtcttgaacgggcagctttaaatgatgttagtgacggattggctagtgaactgaacgagattgcagaagccagctgtgtttcaattgaaattgatgaaagcatgcttccaattcattctgatttacctaagcttcatcctaactggaaagaatgggctttgtttggcggtgaggattttgagctgacagggacggtttcaaaagaggagtgggaagtgttgaagcagcagtgcgcagcacgtcaacttcccattacaaagattggccatgtcagggaaaaaacaaaatctaaagtgatcctaaaaacagatcaaacatcaatgatcttagagaaaaagggatataatcattttaaataagacgggtgactcgtgtgaagcaattaaaatggagaactgtaaatccagaagaaacaaaagcaattgccaagcttgcggcagcgtttgctaaaccgggagacgtcctgacattagagggcgatttaggtgcaggaaaaacgacttttacgaaaggttttgcagaagggctgggaattacacgtattgtaaacagtccgacttttacaattataaaagaatataacgatggcgtacttcctctttatcatatggatgtgtatagaatggaagatgaaagtgaagatttgggacttgatgaatattttcacggacaaggtgtctgtctcgttgaatgggctcatttaattgaagaacagctgccgcaggagcgactgcaaattgtcatcaaaagagctggtgatgatgagcgggaaattacctttactgctgtcgggaatcggtatgaaatgctttgtgaggagttaagtagacatgacaatattagcaattgatacatcaaattatacattgggcattgcgctgcttcgagaagacactgttatagcagaatacgttacatacttgaaaaagaaccactctgtaagagcgatgcctgctgttcattcattgctgaatgattgtgatatggcaccgcaggacctttctaaaattgtcgttgcaaaaggccctggttcatacacaggagtaagaataggtgtgacgttggccaaaacacttgcctggtctttagacattccaataagtgctgtatcaagtcttgagacgcttgcggcaaatggccggcattttgacggtctgatcagcccaatctttgatgctagacggggacaggtgtacacaggtctgtatcaatataaaaatggacttttagagcaagctgttccagatcaaaatgtgatgctggcagattggctggagatgctaaaagaaaaggatcgtcctgttttgtttttaggtcatgacacttctattcacaagcaaatgataaaggatgttcttagaacaaaaggattcattggaactgctgcccagcataacccgcgtccttcagaattggcttttctcgggaaggaaaaggaagcagctgatgttcatgggcttgtcccggattacttgcggctggcagaagctgaagcgaaatggattgaaagtcaaaagtagggtgataggatgaaaacaaaagcagcggtcagaaatatgcggcttgaagatatagatcacgtatacgaaatcgaagcatcctcctttacgtctccttggacgaaggattcgttttatcatgagctgctggaaaatccgtatgctcattatctcgtgattgaaaaggacggccatgttgttgggtattgcgggatttggattgtgatggatgatgcccagattacaaatatagcgataaaaccagagtatcgcggccagtctttaggagaaacgctttttcgctcagctgttgaactgtgcaaagaaaaagacgcaaggcggctttcgcttgaagtgagggtttcgaatcatcctgctcaaggcttatataagaaattcgggatgcagcccggcggaataagaaagaactattatactgataacggggaagatgcgttaattatgtgggtgacgataaatgagtgagcaaaaagacatgtacgtattaggaattgaaacaagctgtgatgagactgctgcagctattgtgaaaaacgggaaagagatcatttcaaacgtagtagcctctcaaattgaaagccataagcgcttcggaggcgttgtgccggaaattgcttcaagacatcatgttgaacaaatcactttggttatagaagaggcgtttcgcaaagctggcatgacgtatagtgatattgaggcgattgcagtaacagaaggtccgggactggtgggagcgcttcttattggagtgaatgccgctaaagcattgagctttgcacacaacattccgttagtaggcgttcatcatatagccggtcatatatacgcgaaccgtcttgtagaagacatcgtgttcccggcactggcattggtcgtttcaggaggccatacagaactggtttatatgaaggaacatggatcatttgaagtcattggggaaacccttgatgatgcggcaggagaagcctacgacaaagtggcgcggacgatgggattgccatatccgggtggaccgcaaattgacaagctagctgaaaaagggaatgacaatattccgcttcctcgcgcatggcttgaagaaggctcttacaacttcagctttagcggattgaagtctgcggtgatcaatacgcttcataatgcatcccaaaaagggcaagagattgctccggaagatttgtctgccagtttccaaaatagtgtgatcgatgtcttggtcaccaaaacggcgcgcgcggcaaaggaatatgatgtcaaacaggtccttttagccggaggagtagctgcaaacagaggcctcagagatgcattagaaaaggaatttgcccagcatgaagggattacgcttgtcattcctccattagctttatgcacggataatgctgcgatgattgctgctgctggtacaattgcttttgaaaaaggaattcgcggtgcatatgatatgaatggccagcccggccttgaattgacttcttatcaaagtctcacgagataatagcgtgagactttttatctgtttattattaacagataattcacaatttatccacatgtctgtgagtaattatggagatattgatggataaagggctgaggtcactgttaataaagtggataaattcagaatattttgtggatagtgtgtataaagcgcttactttgtttatttattaggggatgttctgtggataaaaagcacctctaaaaagaggtgcttgacttttttaatcttcttctgtggatagttcttcccattcggacaaaagagattccagctcctgattaagcttctcattgtctgcatggatagcttgtactttttcatgatcctgatagacttcagggtcacatagcaattcatcattgcggctaatgttctcttcaatggtttgaacagtggtttcaatttcttcaatccgacggagtcgttggcgctctttctttttccattctttttcttcctcgtaggaacgtttggagtcagacttcactgtagctggcgttttatcagtttcctcttgctgattcattttctccaattcaagctgctctgtttttttctctgtataataatcgtaatctcccagatactcctctatatggcttgaagaaagctccaatactcttgtggcgattctgttaataaaatatctgtcatgtgagacaaataacagtgtgcctggataatcaatcagcgcgttttcgagaacttctttgctgtctaaatccagatggttcgtcggttcatcaaggatgagaaagttggctttttgaagcatcagcttagctagagccaatcttgctttttcgcctccgctcagtgaatgaactggtttcagcacatcatctccggagaataagaaatttccgagacacgttctgatttctttttctgggagcccggggtactcgtcccacagctcatcaaggacacgtttagaggaagtcaactcagcctgttcctgatcataatagccgacactgacatttgagccgtatgagatcgttccttgatctggttttagggtgtctatcaatgttttcagtaatgtcgatttaccaattccgttagggccgacaagcgctgcgctttctcctcttgtgagcatgaatgacacttctgttaaaagcggcggctggttttcatagctgattgtgagatcctgaacacgaaggacttcgtttccgctctgttttgtaatatcaaaatgaaagtttgcggatttttcatcgccgagcggttttgacatgacttccattcgctccagctgctttcggcggctttgcgcccttttggtggtagaggctctcgccagatttcggtctacgaagtcctgcagctttgcaatctcgtcctgctgcttttcatacattttaatatctttctcatactgcgcggctttttggtcgagataagcgctatagttgccgtgatactttttgctttctgctcttgatacctcgtatacctggtttactactttgtccaaaaagtagcggtcatgcgaaacgatgaggatggcgcctgaatagccttgcaaataatgctcaagccaggtaagcgtatcaatatccagatggtttgtcggctcatcgagaatgagcaaatcaggctgtgttaacagaagcttacctaaagccagtcttgttttctggcctccgctgaggctttgaacctgtgtagaatcgtcaaaatggctgaagccgagaccatgcagcacagatcttacatccgcttcatattgatagccgcctttatctttgaattcctgctgaaggcggtcgtaggttttcatgatgctttctaattcacccgggtcagctgccgccattttttcttccatagcccgcatttccttttccattgcttttaagtggtcaaaaacagtcagcagctcttcttttatggtaagcttagaatccaagccagtatgctgggcgagatatcccattgtaatatctttcggtttaataatttcgcccttttcatacgaaagctggcctgcgataattttaaggagcgtggattttccggcgccatttcttcctacaatggcgatgcgatcacgatttctgacttccagctttatattgtttaaaatagtatcagcaccaaacgatttggacagctgattaacttgtaagatcatcatattatttcacctctgctataataagttaagtgtagcttatgaaccagaagtcagcaaacaatacattggccatataagacatagagaagaaaatagtgtatgatctgtttaaggagcgttttaatatgaatggattttctcattttaatgaacagggcagagcccagatggtggatattagcgaaaaatcttcgactgtccgtactgcggcggctgtttcaagcgtacacatgaagaatgaggtgtacgagaaaatacagagtcacgatatcggcaaaggagatgtactggctgtcgcacaggtggcaggcattatggccgcaaagcaaacgtcgaatatcattccgatgtgccatccgctttcattgagcggggtagatatatcgtttgactggaaaataaaagaagcagaagttatacttcatataaaagcacaggtcaaaacgaaagggagtacaggtgtggaaatggaagcgctcacttctgcatcggtgtgcgctcttaccgtttacgatatgtgcaaggctcttgataaggggatggtcatcggccctactttcttgctggagaagacaggcgggaaaaacggtgactttaaaagagaactatccgagtataatttggaggaccaaaaatgaataaggatcaatcaaaaattccgcaggcgacggcgaaacggctgccgctttactatcgctttttaaagaatcttcatgcgtcaggaaaacagcgtgtatcatccgctgaactcagtgatgccgtaaaggttgattctgccacgattcggagggatttttcctattttggagctcttggcaaaaaaggatacggatataatgtggattatttgctgtcttttttccgaaaaacgcttgatcaggatgagatgacagacgtcatcttgattggtgtcgggaacttgggaacggcatttcttcactataatttcacaaaaaataataacacaaaaatttctatggcttttgatataaatgagagtaaaataggaactgaggtaggcggcgtgcccgtctataaccttgatgaccttgaacaacacgtaaaagatgaatcagttgccattcttacagtgcctgcagttgccgctcaatccattacagacagattggtcgcattaggaatcaagggaatccttaattttacgccggcccgtttgaatgtgccggaacacattcgaattcatcatatagatttagcagttgagcttcagtcactggtttattttttgaagcattattcagttttagaggaaatcgaatagagggaaaggaggagcccaaatatgccgatcggtcctggaagccttgctgttatcgcaatcgttgctctgattatcttcggtcccaaaaagctgcctgaattggggaaagcagcgggagacacacttcgtgaattcaaaaacgctactaaaggattaacgagtgatgaagaggaaaaaaagaaagaagatcagtaagttaggatgacacgaatgaaagtgaatcaaatgtcgctgctggagcatattgctgagcttcgaaaacggttgctgattgtagcgctggcgtttgtcgttttctttattgctggattttttttagcaaagccgattattgtgtatctgcaagaaacagatgaagcgaagcagcttacgcttaacgcgtttaacctgacagacccgctttatgtgtttatgcaatttgcgtttatcattggcatagtcttgacctcgccggttattctttatcagctttgggcttttgtgagcccgggcctctatgagaaagagcgcaaagtaacgctcagctacattccgatctctattttgctgtttttagcgggcttatctttttcatattatattttatttccttttgttgttgattttatgaagcggatttctcaggacttgaatgtcaatcaggtgatcggaattaatgaatattttcattttcttctgcagctgacgattccgtttggactgctgttccaaatgccggtcatcctcatgtttttgaccaggctcggaattgtgacaccgatgttcttggcgaaaatcagaaagtatgcgtattttacgctgctggtgatcgcagccctgattacaccgcctgagcttctgtcccatatgatggtcacagtcccgcttttgattttatatgaaatcagtatccttatatcgaaggccgcttatcggaaagcacagaaaagcagtgcagccgatcgggacgtgtcttctgggcaataataaaaaatccatttctcatgcgagaaatggattttctttatttctggttctttttgattttaaatgaaaaggcgaacatcttaaaagaaatgctgatgttgtaagcggcgaacaccatcagcaggatggagtaaaatgaccacatgctgcctggcgagcttgcggcaagataagtaaagatgcaccctacggcaaagtagatcattccccaaactaccgggtttctcataaaaataatcctccaataatcaattgcatttgtgtgctctgctgttcaaggtaattccgaacaggctcaagctgcatgatgacgacgaatgtattcatcattaaatgggcgaaaatcggcacccatatccgttttgttctcgcatataaaaaggcaaaggtaaagcccattgctgtatatagaaggagatgcttcaaatcagcgtgaacaataccgaagataaccgagctgatcagtcctgcaaaaaagaaattcgttttttcgtacagcgcgccgaaaatgatttttctgaagatgatttcttctaatataggcccgacgatggaagaaacgataatcatgagcgggactgcctgaatgacatccagaatcgcttgtgtattttctgattctcttccgatgccaaaaacataatattcaatagagcctgctattccttgagagaaaagggcaatgaaaaaaccggctatcgcccaaaggatagaaagtccgattgagtccttctgtccgtttcgcagcgtttctttcggaacggttctcagaatgagcagaacaacaacgagacaggcgataaagctgataacggaccataatccttgtgcatgcagcatattttcatctgtaggctgtcctccggcataaccgaatttaaataacaagggaatcgcgattaatgcggaaaactgcatgatgatatatgtcaaaataataaaccaatactgttttctcaaatggtatgtactcctttgttaagtgggtttcgttcatctacagctattgtaacataatcggtacgggggtgaaaaagctaacggaaaagggagcggaaaagaatgatgtaagcgtgaaaaattttttatcttatcacttgaaattggaagggagattctttattataagaattgtgttagcactctttagtgctgagtgctaaaattacatattcatactattgaggaggttattacattgttaaagccattaggtgatcgcgttgtcattgaactcgtagaatctgaagaaaaaactgccagcggaattgtgttgccggattctgcaaaagaaaaaccgcaagaaggcaaaatcgtggcagctggttcaggtcgcgtgttagaaagcggagagcgcgttgctttagaagtaaaagagggcgaccgcattatcttctcaaaatacgcaggtactgaagtgaaatacgaaggtactgaatacttaatcttacgtgaaagcgacattttagctgttattggctaattcttaaataaacaatatttaaaacatttgaggaggtcttgtaaacatggcaaaagaaattaagtttagtgaagaagctcgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgagctagaagacgcttttgaaaacatgggtgctaagcttgttgctgaagtagccagcaaaacaaacgacgttgccggtgacggtacaacaactgcaacagttcttgcgcaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgacgaggaagtcggaagccttatcgctgaagcaatggagcgcgtaggaaacgacggcgttatcacaatcgaagagtctaaaggcttcacaactgagcttgaagttgttgaaggtatgcaattcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgctgaggatgttgaaggcgaagcacttgcaacacttgttgtgaacaaacttcgcggcacattcaacgcagttgctgttaaagctcctggcttcggtgaccgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgcgtgactcaaatccgcgctcaagtggaagaaacaacttctgagttcgacagagaaaaattacaagagcgtcttgcgaaacttgctggcggcgtagctgtcatcaaagtcggcgctgcgactgaaactgagctgaaagagcgtaaacttcgcatcgaagacgccttgaactcaactcgcgcagctgttgaagaaggcatcgtatccggtggtggtacagcgcttgtaaacgtatataacaaagtcgctgcagttgaagctgaaggcgatgctcaaacaggtatcaacatcgtgcttcgcgcgcttgaagagccaatccgtcaaatcgcacacaacgctggccttgaaggatctgtcatcgttgagcgcctcaaaaacgaagaaatcggcgtaggcttcaacgctgcaactggcgaatgggtaaacatgatcgaaaaaggtatcgttgacccaacgaaagttacacgctcagctcttcaaaacgctgcgtctgtagctgcaatgttcttaactactgaagctgttgtcgctgacaagccagaagaaaacgctggcggcggaatgcctgacatgggcggcatgggcggtatgggcggcatgatgtaaaaccgacaaaaaacccttgatttacaaggggttgtcggcaacggacgtcatttttatgccctattgatccatttataaattttcgaggcttctcatgagttcactgaacttgtgagaagcttctttttttctgtcttttttgatgtgtaaataaacctgtgtagtatgtacgggcatacatggcatttatggaccgaaaacaaaagcaaaaaaggaatactgagtccttttctaaaatcgaagcagacttttttgccaaacacgtcatctgcaattgatattattttatctggcattttaccgtctcgataacgattagaaacgtttactatatatgactcgctttctttatggaagctatgtaagtatcagaatgcaatttcttccctatcttcaagatcaaaagtttcaggaaagggggtagcgccgaatagattttgacatattctaaataatcttttgggaactttacttgtaatgtgtcttctacttcattaatttccttgttactaacaggttgctctccgaaatcccattcaatcatatgaaatctccgcctcgatatgtaaaacccttctttatgtaagaagagttttaattttattcagcctttaaatatgtccggaattttatcttgccatattaatagcaattctctaaattgatcggtttcaattgagttttcatagggttcttctatcctaaaagagttttcaacaattgtcacatcttttttaatgagaacacttgtagcatttaactcaatctcaaaatcttcatatatcccttctaaaaccttctcaatgtaatctatatactcgttggcttgttcttctgtagcgatgttttcaatgaaatcagagaaaatactgatttcttctggcaatactattcctaaatcaccaaatggatcttcttcaaatttatatggatatttcatatgttatttcaccttcaagattattttttatataacgggtatgcagttgctattgttccatccttatttaaatacatttctatttttatacccgacgcagacatgcccctgaatttatttgagccgatttgctttttagtttggtaagcttcatcaatagcttttaatacatctgcacggttccactctcttgggaagaaactagaatcagctatttttttaacaccgtcaacctcaacctttgccatataaactccgtttttatcaggttttttttccgtaccctgaataatttttccgcccatcatactttcatggtgataaccaactgctttaccgcgtttatttatttctccatggtagatgtgcttcattgtacctgtggtatactttccattacccgaactgaaattagatgttgtagatttagttaaaatactctctttttgattttcaataatactttttaacaaaggagtattttttgcattatacgtattgtcaatatctttagctatccctacaagtgcaggttcatatttattttttaataaggggttaataaagtcttttccctttaaaagccctttattgacatgagcagcggctgttccaccttcaactactttacctactttagaaagcttggtagtcgtttgcactgcggcacctgcaccttttgggccaacgatatttcctatcgcataactgatataatgccctttttcgtatgcatcgccatttaccattttatcattccatgagtcgatcaggtttgtccagatgatttttgaataagagggcgcgcttaaaactgttgaaattgtttttgtgagttttagttcggtgggaagctgtgaatattcccatgtaccaacaaccaagtctttgacgccatatatcgtatcgtcaatcacatcgtcaattccatcattaactccgtcgacgaagtcaattactgtcttaccggtattgattacactttcaccgacggccttcagctgttttgcttgttcaagctgtaccacatactggagctgttcaggggtaagattctcatagccgaccttcttggcaatttctaagtattcatccggatcagtcactccgtcagctagcttcttcttcaattctttgatttctcgttctttcgcttcatctttcttgatcttcaaataaacttcagtctgtttctcaatatcgccttttttcttatgtatgtcactttcacggtacgccttggcgttgtagtgaatgggcgtagcgtttttgcctttgcctgtggattcctcaagcttttggaagtccttcttgatgaattgctcgtttggctctgactgggcatattcagtaacaagtgcttcatccacgcttcctaatttatcgactgtttttttacgtttgtcctctgcatctgcaagttcgtctttgaagtcttctgtcgagaacaaatcaagcggaagaatatcgtcgatatcatttaaaatatctttcatcgctttcttctgttcagacataatggattttgattttgtgtaggcgttagccagctcgtgttctaagaaggattcttctatatatgcatcagataagctggcgtcctctaaaatgcctgaaatacttgccaagaaagcaattttcatatcaagtaagtcaatccaatcgccagctacacctgcgtggtcttgataaaatgctttaatgttgtcagcacctttgccggaaaactcactgtcatctaaatcagctacagctttaaaagccttttttagattgaccatctgacttcttaattctttgtattcctttgcacgtctatctgcttctgaaagcagtgagttggcttcaaatactttcatgttcatatcctttcgtttgaatagctccaacaagattttaccatggggaaatgaagaaacagactaaatgtgatacaaaagtggtgaaatggtcaattttaactatgtcattttacctatctgaatctcttgtttgggttaccgccgacgcctatagctagaagggctttctacagttagatttatagaccgaaaaaaattgaaggttattgaaataaataactccctctcatagagagagagggagttatttatttttgttataaaaattcattgtaaaaaaagataaaactaataaaactagaaaatagactatgaaggttgagataaagttccaagagaaaaagttaaagtctttatttagagaataaaatacaatttgacttactaaagttattacgaaaacaactgttattaatttagagaattttttggtcatgacaaaacacctcttccaatttagttaaataaacccatttaatatagtagaatctttggtaaaatatagtatgtaaataacgattaggaggatgttctatgaaaaagcttttagctgtagtgttaacatttactatgataacactaatgttcggaagtacgtcaatagttcaagcggaggaaaagtgtccaacctgtgagaaaacagatcctttagtagcgcctaccacaaaagatctaaataaaactattgaaatattaaaagacaataatgtgaacacgttagctttggataaagaaaaagctgcagtagtcgaaaatgataaagacaaagctgtaattatcgcagaaaagctaggtgatagtaaagataagattgagtataaccagtattttgttgacgttaataacgaaaaatttgtaactttaaaacaaaaagttgaaaaactagatgataagactgtaaaagctgaagtcataaacgtagaatcaggagcaaaatactctgttacaattgataaagacggaaataaattagatgaaaattttatttcaggaaagtctgctgattttaagcaatcaagtttatgtagtgctatcgtaggtgcagttcttggtacaggatctaaatttgcttgtattgctgcttgtacagctgtaactggaggttggggagcagttgcatgtggtgtattatgtgcagcagtaactggcggaataagctgggctggggcaaaagatatgtgtgaacaattattcggttgaaaaacgacgctcctatataggagcgtttttttatcactagtaatatggagaaattaataaataaaccaaaacacccgtaaggctaacatacagccaaattggcattgtccaacgtactatttttcggtgtttttgtgtctgcattgttaaaccccaaattaatgaaaataacgctaaaggtacgacaataccagcaagaatactatgagaagttagaataatgtagtaaaagtatttggcgagcccttctcctccataatgagtggtctcttgagataagaagtggtaagttaaatatgaaaataaaaataatattgttgaagaaaatgctgcaagtatgaaagctctgtgaagttttatgttatgcttttttataaaaattaaagctgctataagaaagatgaacgtaaaactatttagaacagcatttatacgaggaaagatggttatattaaaattcacctctcccttatactctaaaggcgaaaaaaataatagcaagataatcacattagctaaaagtgaaagtgtgattactgtttttgtataatttgagttctccttggacctttgagtctttattctattcaaacttttcacctccctctctaaattaacatgattttttccataatgggccctatatgaaaaaaacaaaacttaattcctattctacacaatacctatttaaggttgtaaacagttattatataagtatgaaaaaatatttttatacagttcatgagatattgtcgttttgctcattttgattactgggatcgttgcaattaacctgatcgactgaggtatatctgagagtattgcgcataccgtattgatgatagccgttgctattaccttgttaaaagggaccattataatgtggagagaaaggcgatatgaaagaaagcgaaagaattaagtttatccagaaagaagttttgactgcagcggaagcgggatagctgcttggcacgtttaagctactcttgtgacttcacggaagctcaagcctgttaaaaaggttgggacagttgcaatgtttttgcttgaacatgtacaagcctttaaaaagaattaaaagccggccggaagaaggccctatgatgaatgaagatcttcttatattaaaaggagttatcgtacgttttatgaaatcctctcatataaatcatcacaacatgtggatatatgggtgcaaaaattaaaaaatggtgagatatcaggtgaaaaaaggacataaataggggcaatgcatggggtggaatgatgtaatctgccctcctaggcccttgatatttagggattcagaagtttttttactctaagaagacttaaaatatcagggattagagagacctttcatacattcgatgaatgtacgagggggtctctttttattggttttatgtattcgcaaattccctaactgcttggctgcgtctttcgtgaagaagcgtcttttcactacaagaatatcttcctcttcatctacttttttggtatcaatggcatttaacatctcacggtatacatctttaacaatgtctgatttctcaagtttttgaagtgcgctttcgatctcatcacggatattctggttattggccgagtatgtttctaatagtcgatcaatatacgttgaatcaatatcatagatcttcactgcgttttctccataaaactcaatgtctgaaaaatccggtgtatttatctgcagttcaatatgtgataggggcagatcctattccgaatatcgggggaatcatcaatagcaagcaatttgatcagtataaagccgtgcatccagatgcaaaaccgttgaaatacggaccagagttgaagcgtcagtggagaaagatgttagatgaagtcattgtacctttggatggcgagctgagataaagacattttgaactaaaggaatctatataacgaaaggccaactgcgacttcagttggcctttcctatttataataaagaaactgagtgagattgctgacagaactactatgcgtactagtcgttttctttaattaccatttccagtccttcgacctccccacgaatcccaatcgcaggctcccacgaatcaatcaaacgaatcgctctctgattagcttccatcgctttcgttttctctcctttacggttcaacagctgcgccatcccgtaaaaataatagatcaactcaacctgattggcgttatgtttgtcatagagcatttgctcaaaggcttcttccgctttctcaaattgaccacatttcacgtaagcgacacccagattgaaataggcttctatcgttttttcgccgccgtacgtggagctgatttcatttgccgcttcgtataattgaatggcttcttcatgatgacctctcgcaaagcttaagtcaccgcgaaccaatagaactctgtgttgaatggtaggggaaatcggttgattttcgatttcgtttaaaatggtctctgctatttcctgttgcccgtcttttaaaaaaagccttgctttgagtgcgtgtccccaaacctttagatcataggcatcgtgagcgtctgattgttcaagaatcttcagcccggcttctatttgctgaagcgctccgtctaaatcattgacttccatcaatgcccagcctgaggtgtcgattcggaagaacgcttctcgtgtgtgttggcctaattgatgggcggcgtcggccgctttacgtccgtattcgattcgcaggggaaggttgattctgcttagaaaatggctaattcgggtgatgagttcgattaggatttctttttgatcggtgtcgcttgcccattggatgacctttaagatgtttggccaatcttgtttcatttgatctaaattccgtcccagcaggtagctccaatagatagagtttggctgttcccgctttaaatgggtttcagcataatcaatataatagtaagcccagcgattgcgggcttctttttcatattcgtgctgttcggacaagtgccgttctccgtaagcgacaacggtttggtgcgctaagtattgtgtccttccttcgcttcgttccggctgaatcagcgcatatgaccgcatttgttccatagcgtaatgaaaacggcgggcgtctaatccggctgctgccgccaggcttttttcatcaggcggcttgctgaaaaagcaaagcgtctgccatagctttcgcgtatcttcattgcatctatcccaggtgcggccaaagaggaattcaaacaattccagcagtgagtagcctgcttttccaagctcatgaatcagctgctgagcggggatgtcatcgtctgccatataggcgatgctgagtgccatggctttcgggtttccggcagtcgctgaaatgaattcgtttttcaggtcagatgatagatgtaacagctgctccagcttttcccgtttattttgaatgttgcatgtttgtaagcatcggtgcacttcttgctgaaaaaaatccaaggcatctgtttggtcaaggccgctcagctgaatagctgtcatttctccgaagctttcccgataggtttgctttacgttttcccgcgctgtgaggagaactttcacgccttgcggaaggctggtgataaattcatgaatgtcacgttctgcagtatcaatgctgtcaacgatcagcaggatcggtttttctctagtgtaattagctaacgcattgcggacgacgaaccgtttttcattgattgatttatcgatttgttctgtgcgcccgagctgataggcgatcgtatttaaaaaatcgctaaagctcaatcctttccaatcagcgctgacccagatgatgctgttgaatgcgggccaatctgaagtatcgtcgacacaggaataggcggcttcaagagcgattgtggttttacccataccagcccagccggtgattaaacagactggtgacggagaaagcatccattgccgtatcgcttccatatcaaagctgcgtccgataaagcgtccggaccagcgtgagggtaaattatgagtgataggctgttctgtaagcgcattcgtttcatggccgggtctgtcatgaaacagccgttttactacattttcaatttcgtcttcactcggagccccgaataatccgtcttttcgcagtattttcgcttttttcaaacaggatgctgcccatacaggcaatgcgggtttgataactgggatagtggtggcttccagcaagtcggtcaaccactcgatatccaagtcggtcttttcgagaatgatccagatcattccgaacagttttccgtcgtcgattcttccgggaatgtagtttgcccccatctgtccgatccagcttttgatcgtgtttggggagactcccagctggagtgcgattttatctatgtaagactgtcctgttttttcattctttttccttctgactttataatcaggatgaagttttagcgttttgacgccaggtgccagcagttgtgcaaattgttttcggttttcaagttcagccataagcctgcacctcctattagtactattttatcaatccagcgttttttgtatatgaaaaaataaaaggacagtgccgctgtccttttatacagcaggaaatgctgttgaacgtgttgaaaagcagataaaatgggggcagtaacagagaaaacaaaaatgtatgcacttacattttattttctaaagaaaggaacttgccaaatgactcacacagtacctcaaaacatgaaagcggctgttatgcacaacacaagagagatcaaaattgaaacattgcctgtgcctgacatcaatcatgatgaagtgttgattaaggtgatggctgtcggaatttgcggatctgatctgcattactatacaaatggccgaatagggaactatgttgtggaaaaaccatttatccttgggcatgaatgtgcgggtgaaattgccgctgtcggatcatctgtcgatcaattcaaggtgggagaccgcgtcgctgtagaaccgggtgttacgtgcggacgctgtgaagcgtgcaaagaagggcgctataatctttgcccggatgtacagtttttggctacaccgccggtagacggcgcgtttgtccaatatattaaaatgcgtcaggactttgtttttttaatcccagactcactttcttatgaagatgctgctttgatcgagccgttttctgtcggcatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaaccgctgagtgaacagggaggatcttcgtattctccctcttgtttactggaaatgaaaacggattcttggggtgggaaatgatgattgaaacagaaaaagtaacggcaatgaaagtgaagcatcagtcaaaatccagtaccggactgtcctggtttgaacgaatcggttatggattcggcgatatgtcgtataatattatctttcagtttgtaaacgcatacttattattttattatacagacgtcggcggcattcagcctgcggtgatcgcaactttgtttcttgttgtgcgtgtgctggatgctatttttgacccgatcatgggattgattttagataaaacgaatacaaggtggggaaaagcaagaccatatttgctgtgggtggcatttccttttgcgctattcacattcttatgtttcacgacgcctcatttcggtgagaccggaaatatggtatatgcgtatgtcacttatattctgcttgggatgtcctttagtatgcaaacgatcccggtgaacagcttaacggggcggatgacgaattcggtggaggaacgaacggttctgaccacaacccggatgattttggtgtatatcggcattcttttatccatttcctgtgcgacaccgcttgcaactgctatcggaggagagaatcaggcgtttggatttcaaatgacggcgctcatctatgcggctgtcagcatcgttttgaatctatttagtttctttactgtacgggagcggattcagcctaaaaagagaaacaaacaagggatcaaaaagacattatccgttttattccaaaacaaacccttgctcatgttaatttcatcatttttggcttttgcgatcgggtttaatattaagctcagcacgatggtgtattattttacgtataacgtcaaccataaagagttcgtatttatgggcaccgttttatttttcggagcagcgctgatcagcaatttgtttattcctttcttttctgagaagtggggcagaaaacaagtcatgatcatcacggcagctctatcgcttatttcttatgccggcctgcattttacgccgtattcttcaattccactcattttcatttggcttttcgcttcaggatttttcacaacgcctttaaatacgcttgcttggggaatggttgcggattgcgtcgattatgcagaatggaaaaccggagttcgcgcggatggtgttgtgatttcgagcatgagctttattaataagctgggtgttgcgttagccgggtcattttcggcaatttacttaggaatcgccgggtatgtggcgaatacagaccagacagttgcgtcattgaatgcaattaaaaatatgaatgctttgattccgggatttttcattttgctttctattattctcatcgccttctatcctttaacggaaaaaagatataaacacatcatctctgagctggagcaaaggtatgcgagataaatatatgtaaaatttttaatattcaatgttgtatttatggcagaaagtaatatactgagactgtaatctagactttataaatgagtgtgataatatgcgtagtcattctgtagtttgtattggggaattgttgattgatttcttttgtaccgatgttgacgttgatttaaaggaagggcgccaattcttgaaaagtgcgggcggggcaccggcgaatgtgtcggcagcaattgccaagctgggcggagacgccgctttcagcggaaaagtaggaaatgatccgtttgggtattttctgaagcaaacattggacgctgtacacgtcgatacctctatgctggtgatggatgagaaagcgcctacaacgcttgcttttgtttcattaaaacaaaatggagagcgtgactttgtttttaatagaggcgcggacgctttgtttacgctggaggatattgaccaggaaaaactaaacgaagcgaaaattcttcatttcggctctgcgacggcactgttatcggatccgttttgctcagcctatttacggctgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggagcttgagattataagcggtgtgaaggatcatgaaaagggagttgcgatccttcatgagatcggagccaacattgtcgctgtgacacttgggaaaagcggaacgcttctttccaatggaaaagaccgtgaaatcattccaagcattcctgtgacatcaattgactcaacaggggcgggagatgcttttgtcggtgcggctttatatcaattggcaaatacggatcagattcaatctgtagatgctgattttgtgaaactgcgtgagattgtggcgtttgccaataaggtcggagctcttgtgtgcactaaaattggagcgattgatgcactgccgagcttaaatgagatcgaagtttctttgtaaatcattgaagatgtttcttgaaagtctttggacttttggaggcatctttttttattgcttacatttttgttcgggtaaaaagttgtatatttttcgtttgatatgtcattttttattaaaaaagtgaaacttttaacgataatagatagtatatgtaacaagggttaccgaattagctttaggaggaacgatataatgagtataattggaagatttaaagatattatgtctgcgaatatcaatgctttattggacaaggctgaaaatccggagaaaatggtagatcaatatttaagaaatatgaatagcgatttggctaaggttaaggcagaaacagcagctgttatggccgaggagcagagagcaaaaagagaatatcacgaatgccatgcggatatggaaaagatggaaagctatgcaatgaaggcgctgcaagccgggaatgagagcgatgcgagaaaatttcttgaaagaaaaacatctttggagtcaaagctttctgagctgcaggcggcgaatcaaattgctgcaaccaatgccgcacagatgagaaagatgcatgacaaattggtatctgacattggagagttggaagcacgtaaaaatatgatcaaggcgaagtgggcagtagcgaaaacgcaagaaagaatgaacaaactgggcgcttctgtttcaagtacaagccaatcaatgtctgcattcggccgaatggaggacaaagtaaataaggcacttgatcaggccaatgcaatggctgaactgaacagcgctccgcaggatgatatggctgatctgactgcaaagtatgacactggcggttcaagccaggttgatgatgaacttgcggcgttaaaagcgaaaatgatgctcgataagtaatacataggaggccgcagctctcggctgcggcgtcattttatcataagatgtgagagggaacggtaatgataatatcttataagtgtccgaactgcggcagtgatatggcatttgacagtgaaaccggctcgttatcctgcagcagctgcggaagacaggacaatattgaaagccttccgaaagaaaacattgcggcacggttttctgatgatgaagcaaaagaatatcaatgtgaaaactgcggtgccgttttgatcacggaagctgaaacgacagcaacgacgtgcagcttctgcggaggtgctgcaatacttgccgatcgtttatcaggacatttggcgccggcgaaggtcattccatttacaatcagcaagcaagaagcggagcaggcatttcgaaagtggtgcaaaaaaggccttctgacaccaagaggtttcatgtctgccgatcgcattaaaagcatcaccggcatgtatattccgttttggatgtttgatttaaatagtgaagtacaggtgagagcaaactgtaccagggtccaccggtatgaagaaggggattatatttgcacggaaacagagcactttgaagcgtttcgtgatatcaatctcgattatttgaaaatccctgtcgatgcctctgaaaaaatgaaagacgaattaatggacaaattggagccttattcatacgaagagctgaaggactttcaaacggcatatttggccggttatattgcggaaaagtacaattataccgatgaggagctttttccgagggcaaaagagaaaatcagcagttatatagattcatacatccattctactttttccggatatacgtcagtcaatgtgagggacaaacatattcacacgaaaaacgtgaacagcttttacgttttgcttcctgtttggatggtcagttacgattatgaaagagcggagcatatctttgcgatgaacgggcaaacaggaaaggttgttggaaagccgccgatcagtcgaggaaaagtggcggcatggtttagcggaatagcaggcgggacatttcttgcgttgaagctcgtctcattgatgatgggaggcggattttgatgcgtagattttttggaaaagcgatctttgttgtgctggctgttttcatcatgatgcctttactgggtatcgaagcggcaagagccactgaatcacagcagcatgtgtacgatcgcgctcatctattgtcaaaaacggagatcggaaaacttgaatctctctcgacagagctgggtgcaaagagagacactgatttcatcattattacgaccaaaagcacaaacggtgaagatattgcagactataccggcaatttttatgatcgttacggaaaaggcagtacagctattctgacgattgatatgacaaacagagaagtgtttatcgcaggcttcaaaaaagccgaacagtatttggacaacagcaggctcaatagcatcagaaatacgatttcatctgatttatccaatgaaaattattttgaagcttttgagacatatattcagctttcctataaagatatgggcataaaaccgggagtaaaccccgacaacatattctttacatggtggtttcagctgattgttgccatcgcagtcgggggaattgcggtttcaatcatgctttatcatgcaggcggcaaagtaacggttaatggaaatacatatatggatcagcgtacgtctgatgtgattgatcaatacgacacttatattagaacgactgtaacaagagaaagaaaaccatcagataaagacagcggcagcgatggcggtgttacgaaaggcggcacgtcatacagtgggagccggggcagtttttaaatgtaagaaatagagaaagggagaggcgtaatgtcgtttttcagaaatcaattagcgaatgtagtagagtgggaagaatttagagatgatatgattttttataaatggaacaatcgtgaaatcaaaaaagggagccgtttaatcattcgtcccggacaggatgctgtctttttgaacaatgggcgggttgaaggagtctttcaagatgatggcgattatgatattgaatcagaaattattccattcctttcaacattaaagggctttaagtttggctttaacagcggcatgcgagctgaggtgctgtttgtcaatacgaaggaatttaccgtaagatggggaacaaaacaggcgataaatattccggcagcgggaatgccaggcgggatgcccattcgcgcaaacggcacatttaatttcaaggtgcaggactatatcagcctgattgataaaatcgctggcgtgaaagatcaatattttgtagaggatattaaaacccgtatcatttctattctggatcagcttctcatgaagtggatcacaagagaagggaaagatatgtttaatcttcaagcaaacgcttttgatattgccaagggaattcaagaggacttagatatgcaattaataagcgacgggatgacggtcactggttttcaaatcatgagctttaattatcctcaagaggttcaagatatgattacaaagaacgcttcctacggtatggttggggatgtgaacagataccagcaaatatcaatgacggatggaatagcatccggaaagatgagcggaggcggagcggcttcggatatggctggaatgatgatgggaatgaatatggccaatcagatgatgaaccaaatgaatcaaaatcagcaggcacagtcatcaggcccacagtcaactggcagcggaagcaaaccgaatttctgtccaaactgcggaacaaaaacgggcgaagccaatttttgtccgaattgcggccagaagcttgtataagaatcatacagtgaaaagtccggagtgatcagcgctcgggacttttttatttaggagaataagcgttacctattgcttgctcctgaacaggccattttcgagcacccgcttggataattcccagcagcaattgacgacgttcctttattgaattgacggcaatttgaaatgtttgctttgataaagccggtatgcctgattgttgaagctttgagatgtctggttccggcggcgcttgttctgcaggatggatataggcagtatgaacggtatccagatagtttttgatacttgagcgcgcttctttgatatgaagctgattcggctgatattgttcaggaattccgtatttgaaaatggttagagcttcatccaatacagcaacagctataatggatgattcctgatgctgcgtgctgtggtaaaaatgaaggatggggaaggcgttatgctgagcggtcagctttcccagttctgatgaggcagcgacaagaagaaaatcaatgtcgtgaaaatctttgccattccatgcattatggacgatttctgttccgtcatgccctagacttaatacactttgggcaaaggagcgtttttgattaaccgcactcaagacggaaatcaaatacgtgacagaaaacgtgatggtaagcagtccttgagctgtttcaataatcgtgacaagcttccataggcctccgttcggagcgaggtcgccatttcctaatgtaaacatgacatagccggaaaaataaattcggtctgaccaggaagccggttcttttgattgagtttccataagtgagtgagggtcactcgagtaaatcaaaacccacccgccccaaaatagactgatccatatcactaacgtcaggcataacagcagaggaccagccatacttagaacctttgcgtggtcaccgctgattctgcggcagcccttccacagccaggcagacaggcatcttgtgatcgggcctgcaccgctctctaaccataacgtggtccataaaaaatcaatcatccccgctgtcaataataaaaggcctgcaatgatataaccctcattcattttggttgcctcccttaagtcagccttcttttattttcttctctatttccttttatcctgagtctgaaacaattgaacgaatgtttgattttacagagaaaaataggtgaagttacccaacacttactcatttaacggtatgaacagaaaatcacaggatttttaacttgattcacacattttcatgaagaaaaacgttcattttccccttgaattggtgattttccttttatagagtaaaaaattttcagaaatttatattgactgaaagcgtttttgtaattatgataatatcagatataacaaaaatataactatcatatcactacaattgaactatcaagtgactattaaatgccaaatgaacaaggttatgacaaagaaatgaccattgctctttagcgagaaatgaaatcgcttccattgggactgacatgctaagaagaagggaaggttatgaggttattggataaaaacatgaacaactattttctgaagcctgcttacgaaatgtgaggaaggcagcagccctggaatgagtttttgacatacgcattttgaaaaagactgggggaaacagtatgaataaacaaggcaatcaaatgtcatttttacgtacaattattttagtctccacttttggcgggcttctttttggctatgataccggtgtgctcaatggagctttgccgtatatgggagagccggatcagcttaatctcaatgccttcacagagggccttgtcaccagttcacttctttttggagcggccctgggtgctgtgtttggcggcaggatgtctgattttaacggccgccgcaaaaatattttgttcctcgctgttatattttttatttcaacgattgggtgtacgtttgcaccaaatgttacggtcatgattatttcccgttttgtgctcggtattgcggttgggggtgcatccgtaacggtgcctgcctatttagcagagatgtctcctatggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgctggcttgtttctaaaggaaggaaagaagatgctttgcgtgtattgaaaaaaatcagggatgaaaaacgggcagcagctgagctgcaagaaattgaattcgctttcaaaaaagaagatcagcttgaaaaagcgacgtttaaagatctttcagtcccatgggtgcggcgtattgtgtttattggattagggattgcgattgtacagcaaattacaggtgtgaattcgattatgtattatgggactgaaattctaagaaattccggtttccaaacggaagccgctttaatcggaaatattgcgaatggtgtgatttcggtattggcaacattcgtcggaatctggctgctgggaagagtggggcgccggccgatgctgatgacaggcttgatcggtacgacaacagcgttattgctaatcgggatattctcacttgtacttgaaggatcaccggcacttccatatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccaatattgctggcagccatcgggctgtccacaacgttctttatcttcgttggattaggaatttgctctgtcttgtttgtgaagaggtttttgccggaaacgaaagggctttcgcttgagcagctggaggaaaacttccgcgcttatgatcacggcggggcaaagaaggattctggggctgaagtgattggataattaaaaaaagaatccgcacccgagtgcggattctttttggtttcaaattagttaggtctgacaaggattttgacttggcttttctctttaataagagccccgaagccttcctcgatcaaatcatctagtacgatttttttcgttacgagtttgtcggctgagaaatagccttctttcattaatgacaatacagccgggaagatgtcgcggtatccgataattccttttactgtacgttctttgattacgatatcgttcggatggatttcagcacctttttcccaaatgctgacgatgacggtttcaccggcaattgtagtggactggatggcttgtcgtaacaccactgggacaccagtgacttcgaatgctacgtcaacaccgcctcctgtacgttctgcaatctcagcgactacatcgtctgttttagacggatcaacgatgatcgcgccaagctcctcagctttttgctggcgttcaggagaaagctcaacagcgtaaatatcggttgcaccggcagccttcagcgcttcaatgacaagaagtccgatcgggccgcagccgaatacagccgctttgtcgcctgctttgagtttgcttgagcggacagcgtatagagcaactgcagaaggttcaacgagcgcgccttgttcatatgataattcatcaggaagtttgaacaaaagctcttcatctacagagacgtattcagagaaaccgccgcctccgccggctaagccgaggaatcccatttgttcatcaaggttgtaggcgccttggtggccgtgtgtagcaaaaatcggctcgactacgacgcggtctccaactttataattttcaacgccttctccgacttcgacaacttcaccggagaattcatgccccattgtgacaggtgccgtttcatttgttaatgggtgcggtttgtcaaccggaataaagatcgggccgcctagatattcgtgtaaatcacttccgcagatgccgcaccatttgactttgatctttacttttcccggctccgtttttggctcttcgatatgttcaatacggatatccttttggttatgccatcttgctgccttcatggattaccactcctataacttttgatgtgagtaattccgcaccggtcaatatgaactgttcacaaaatcgccatttttaaaaccaaaaaagaaatgaaatttttatataatataatctacgtttttttgaaaaaagaaactttgaagaaaaaagggtctcgcacactcttttttctttatatgagagtatcaatcgtttacatagctatgaatttggtttgaacaatacggtaatggttcgttcatattgaatgcgacaactactctatcaataattataacgctaatactgctattataataggataatcttccatggtttattttagcagaggtaacttttttgactttgtaacattactgtaaggatattgaaataaaaaatagctggttgatcgtgtataatcttcctagatgttaacaaacagggggacgaaatgttgaagaaagtcattttagccgcttttatcttagtaggaagtactttgggagcttttagtttttcatcagatgccagtgcgaaacatgtgaacggaaatattacttggtataatggagtcgggaaaaaaggctcttcaggtaagaaacttggacattgggattgtgcgaccaaaatcggatttgatgttcctagaaacgggacaaaaatcagagcttatgcaaaagcgaagcctaaaaaggtgattacggtttataaaaatgatgttggcagaatgcctaatgcagtgctggatgttagccctaaagcgtttaaagcgcttggatatccattaagcaaaggtaaagtagcggggcattacagctattagtgtacatatataatctggaaagcaagaagtgacattcttgctttttctattggtggagataaaagatgaaaaaaagaatcatattattgttagcagtgataatagcggcagctgccgcgggggttgcgttttattttacaaaggataaaggccatgagaaggctgctgatgtttcagtcaataccgatagcggtgatgagctgctggtttcaattacagatacggatctgctgacaaagtattatgaaaatgacaaggtgatccatgaggagaagctgaccagctatccggcatttgccttggatcaaaaacagcaggtgctctattatacgggcaataatgaacagaatgaaatgaggctttttaaactggatctaaagtctaataaaaagacggtgctttataaaggcgcggagagtgcggacagtttgtttttatcaaaggaccgttcaaccatctatttccgcttaggaaaagcggacgaaagcaattttcggatcgccgcttttgatctgaaaacgaaaaagtacaaaaatctttatcctgccgctaatgatcaggataacaccgtcagcagcttcttttataaccaaaaaaacgattcatttgcattgcttcattattctgtagaagaagactacaagaaaacagatgaagcaaacgaaaagggcatcgaccctgaaccgacaacgattcattttgcggaaggccgccaaaataattttaatgagctgaaaagcctgaaccaatttatcagcgatattgctgtttctgatgatgataaacgtattttattcacatcatatacgcaaaaaggaacggagcaaaccgcttctattcaaatgctcaatgcggatacgaaaaaatatgaaggcatcatctcaaatcaaaaatcatttaagctgttaattgacgcacagcctcagttttctaaggatgggaagaacatttattttcttgccgaagccaagggggctaaaaagctgaaggacgaaacagggcgtgaagctaaggtgcggacgatttattcctatagccttgaaaataagaccttcaaaaaagtatgggaaaatccgaacggcatcatcaacagcttttctgtgattaactaataaaaaccactcggcttgggctgagtggtttttttaatggatgaggtgcagggctaatgatccgagccatttaaagatatgaatcagagggaccgacaaaaacagaagttcaacatagaagttcattgcaacatccagctttttgaacgcagctctttttttcaagtctttttgctgctggtttgggatcacgttatcgctcctcttatatccatattacaccattaaaacagacgaaaaagccctaaacgtttacagttttgggcttctttcttcgtatttggcctcttgcaatgagaggtttttattctgaaatatagaattttgtctccgttcggggtttgtttgcttattgcttgcaggagtctgcatttgttatagggaagaactagcttgttttcgtttggctgttgttttggagattcactaatgaacggatgccgtcgaccattttacttccgcacaaagggcacaatggcgtatcactgctggcgaagttttttcgggtccagccattacagtcttcttttgtgcattcccaagtactcacatcttcttttggcagcggttcttgatttcgtttgttatagtaagacataaagtcacttcttccctcatgtattttactgcacatttcctattgtctcatacttttccctaatctcctaattcctttttctttatgactttccaataaccccatctaaaaaggagaggagtgtgctgttaaaagcatctggctcttctaaaaacgggcaatggctgcttttaggaaaggtaacgagtgtcgcgtttggaatattgctgcgcaagtgttccccagctgctgtagagaaaaatttcttgtcttccccgaagcacagcaatgccggcacattgatgttttggagggtgccccggtaatcagcggccgtttggttaaataaaatcgtgctagaaatggcagccggctgtttgaggatttctgccagcatccattctgtttcggtctcggcaggcggttctgcgaacatattctggatgaagctttcgtagaaaggcagcgggtcagtttgaatggcgtgcatcgctgtttttaagccgtcaaaatcaaatggaccatgttcccagccctcccattgatagtccgaagcggattgatcgatgatcacagcggcttgaatgttatcattcccaaactgattgagataatcccatacgacaaaagcacccattgaccagccggcaagaacgacatgatcaagctccattgcatttagaaattcccttatgtcacgggcatattgggaaatggtgtggccgtgaagcactttgtcagattcgccgtgtcctctaagatcaagacgaatacattgataattggcagaaagcaccgaaaattgtttgtggaaaaattgtccgctcatcagcaccccatgtataaacaggatcggcgtcccgctcccgtgtgtttcatagtaaaggcgtgtctgatcttctaatatgatgtatggcatgtttctcctcctttagtttccatcatgagtatggctggctgctgttgagctgatgatggcagctgtcgcggctgcctgctgcgcttgaatgactgtttcgatagcggtgtatagtcctgattccatcagcagatttttctccatatgctcactgagatagaggctgacagcaattttaaagttcatttccttttgccatttaaaagctttttcctggtttaattcgtcagtgatgcacaaaacggttttgatatctggctcttccagaaatgtgaggagagcaaggtctggataatgataatcctttgtttttttgacagattcagtgatcgattgatatatctgtttgcaagcggaaacaagcatttcgggctctttttcactttgcaaggccagaatatggctgacctgatgtaagtactgtccttttttaaagccgttggctgccagcagctgatagcatgtttccgccttctgtagcgcctgcaaaccttttccgttttctccaagcagtacggcaagcggaacattctgagttgaagtgaggaaataatgatttttcttcatctgctgataaactgctagccccatgttcatctgttctttttggtttgtcgtttcagatttgccggtgagcaagatcagagcggaaaggtatgtgaacatatcccgcttatatcctagcttcaccatttcattgtatacatcgataaaagtatgaaatgtttgttttgcctcatgctgaaaatgaatgtccagaatagatgcaacagtaaagcggtggtgtgaattgagtgttgagaagctgccgatgtttgatttgatatagctgctcaaatcataaaagcgctgaaaatcaaactctcttttattcacaatatatgcagaagaaatgagcattaatatctgatcgtgtgaaactttccattttaattttggttttaattcagcataaatggaaatgtattgctttattttttcatgtaggttgtgtgtcagcataaaaagcagctcctttttgctgtttttacgtaatacgataaatagggccaaaggtttcataaagaaaaaacttgcctgctagaggcaagtttgtcgggttatttatggggatctgttatatccatcggtctcatcatgtcatagtcttcatgctctagaatatggcaatgccatacgtatcgtccgctgtacggaccaaatgtcgccgcgattctcaggacttcacctgcatgcgcttgaatggtgtctttccagcccttttcacttggcggcggcgggacagccggaccggtataggacaattccccgctttcttgataacgggcgatatcaaacggccgccggtctaatacacggaaggagactagatgcaggtggatcggatgtgttccgcgtgtcgggttgataatggaccatatttcagtagtgccgacttttggtgcttctgtgacgggatcgtgccagcgtttgttattaagcagaaggacaggtctgccgtattcgtcctgggtgcctgccagttttaacgttctgatgttttgtattctttcatgctgtaccgaagggtatgaggcgaggtacttcggctttctgctttcgtctttttgtgccaatggttttgtgactctgaattgcatgatattcgcatctgtttcaggattgacgtcaccgccgcagcccgcgctgtttgccaaaatgatcgattctccttcatacgctgtgaagtcaatgatgatatcataacgttcagcaggcgcaaggctgaaagaattcagtttaacagatcgcggcaggagccctccatctgaaccaatctgaataaactctccgccattatcgagtgacaggttataggttcttgtattggaggcgttgatgacacggaatcggtatttccttggctcgacttccaagtatggccataccttcccgttgacgagtatggtttctccgcaaaaagccggaacgattgagggattaggcagtgacggagaagggttttccggtgcgctcggataaaacaaagaaccgtcctcattgatcgtgcggtctgtgataagaagcggcacatcgtattcgtctgaaggcagttttaagcgtttttcctttgggtcatgaatgatataagcaccgacaagtccggcatagacatttagcctggtgagcgccatggcgtgatcgtgataccacaatatagccccgcgctgctggtttggataatgataaacctctcttttgaaataaggtcctgtttgttcaaagtctttggaaaaccaagcctccggatacccgtcactatcatctggcgtgacgccgccgtgtaaatgaacaacagtctttacctcgggctcttcatgctggctatcactgtgatgaatggtgtgatcaatcggaaggaaatgcgtggaaggtaggttattcatccattttacatatacgttttcatttcttttaacctcaatggtcggccccggaaataagccgttgtagccccacaggtgggttggagggagatcgcgatggagctgatgggtgcattcctccatggtgacttcgtagtatgttttttcttttgattgctgtactggctttagtgtatctgggattgggagagcatccacaaatttttcaagtgtcattttcatctgtccttatctaaattttccaaattggtactatagttaatgacaataaggacgtgatggttacaaaaaatcttcgtgctgcagactgcccgagaaagaaaataacaaaatcctaaacggcaggccgtttaggatttgatcagcattaaggcaggatatcgggctgctgctgtgtgactgggttggcagccgctttctcgctcaccttgcgttttctgaacacaaggtaagaaatcagaacgattcccgtgatgacgcctgtcagcagcagctcgtctctcatggaatcaataaacgccatggacactaaaattccgcaaatggcgaggatggtcaagtaggttaggaaagggaagagccacattttgatcttcaatgcttctgggtttgttttttcgagttttttccgcattttcagctgggaaactgcgatgacaagatagacgagtaaagcgattgcgcctgatgagttgactaagaataaaaagacggtatccggtgaaaaatagttcattacgaccgcgatataagagaaaaatgtcccggccacaatggcttgtacgggaacgccttttttgctcaatttcataaaacggcgcggcgcttcgtttctttctgcaagtgaatacagcattctggatgtggtgtacaaacctgaattcaggcaagagagtacggctgtgaggacgataaagttcataatctgtgcggctgcgggcactcctatatgctcaagtacagcgacgaaagggctttctaaaatatttgctgaattccatggcaacagcgctacgacaatggcgattgagcccacgtaaaagacgatgatgcgccatacaacggatctggtggcttttgtcacagattcgatcgggttggatgtttcccctgctgcaatggcaacgatttcagttcccataaaagagaagatgacaacgacaatgccgagcaaaacggagctgatgccctccgggaaaaatccgcctttgcctgtaagattcgaaaaaccgactggctcactgcccggtgcaaagccaaaaataaaggcaaaaccaacgattagaaaagcaatgatagtcacaactttaatgagggagaaccaatattcaaactcaccgaaagacttaacggagtagacgtttgtcagggtgagcacaatggtcaagatcaaacttgtcagccacagcggaatatcatggaaccagtattgaataatgccagcaccggcaatggcttcgatcgcgatgacgatcacccagaaaaaccagtacagccagccgattgtaaatcctgcccacggtccgatggcgtcgtgagcgtattgagaaaacgatccgctcgtcgggtttacggcagacatctcaccgagcattctcataataaaaatcaccaataatccggctaacgcgtaagaaacaacggcacccggaccggtcgagtgaatcactgaaccgctgcctacaaataggccggctccgattacaccggcaatcgaaatcattgtcatatggcgggtctttaattccttttttaatcctgattgagactggttcataagttacctccttttaaaatgcaatcattactgaatattatgataattgaaactctatcataaatatacagtttgtcgaaaattcgtgtaagaaaatataccagcttatttcaaatttgtagtgttttgtttgcgctttcagcgaatgtgtggaaaaaatgtttcgttttttatttgctgtgtgattttgtgtactatttacaattcgatagaatgcgagaagcgctggtgtcattggatctgatgggctttttggcggagcaaataaattggatgagagaaaaagtgttccatcgtcactatttttctgtggcgggtgaatcatgtttctgtagacccactgcggatcagctttgtaagataataataggaaaatgtgagcggggaggaggttttgtatggagagatatgatgaactgaaaaagggagaatccggagcgctggtcagcattgccgcgtatctagttctttccgcaattaaactgatcatcggttatctttttcactcggaagcacttacggcagacggattaaataacacaactgacattattgcttctgttgctgtgctgattggcctgcgcatctctcaaaagcctcctgatgaagatcatccatacggccactttcgagcggaaacgattgcatcgcttatcgcatcgtttattatgatggttgtcggcctgcaagtgctgttcagcgccggagaatctattttttctgctaaacaagagacgccggatatgattgcggcttggacggcagcgggcggggcagtcctgatgctgatcgtttaccggtacaataaaaggctggccaaaaaggtgaagagccaggcgctccttgctgcggctgctgataataaatcagacgcattcgtcagtatcggcacatttatcggcattgtagctgctcaattccatcttgcttggattgatacggtcactgcgtttgtgatcggtctgcttatttgcaagaccgcatgggatatttttaaagagtcatctcactctttgacagatggattcgacataaaggacatttccgcttataaacagacaatcgaaaaaatctccggtgtgagccgtttaaaagacataaaagcaagatacttgggcagtacggttcatgttgatgtggtggttgaggtatcggcagatttaaatattacggaaagccacgatatagccaatgaaattgagcggagaatgaaggaggagcatgcgattgattattcgcatgttcatatggagcctttagaacacaaataattgagcttcctgccacaggaagctcaattatttgtgtgttttggccagctttattggaaacaatttgctagaatcgtttttttatacagattgctttttgtggtaaagttaggttacattatgatgaattttgtagatgactaggaggaaaagaatggcatatcaagaagacctgcatcctttgctggggaaagcagttgaacatattaatagagtaatggttggaaaacgagacatcgccatactcagcttagcagcccttcttgccaaagggcatgtgctgcttgaggatgtacccggagtcggaaaaacgatgatggtccgcgcgctggcaaagtcaatcggcgctgatttcaaaagaatccaattcactccggatttgctgccatctgatgtaacaggggtatctatctataatgcgaaaacgatggaatttgaatatcgtcccggcccgattatgggaaatatcgtgctagccgatgaaatcaaccgtacctctccgaagacacagtcggctttgctcgaagcgatggaagaggggagcgtcacggtagatggccatacgatgcagcttgccgatccgttttttgtgatggcaacgcaaaacccggtcgaatatgaaggaacctatcctttgccggaagcccagcttgaccggtttttattcaaacttcggatgggttatccgtcctttaatgaagagcttgacgtcttatctcttcaggaaaaaagccatccgattgagacgcttgagccgattattgcaaaagaagacttcatccgtttacagcgggaagtgcaaaatgtccgtgctgatgacagcattaaggaatatatcgttgaaatcgtgcagaaaacgagacagcatccttctgttcaattaggcgtcagtccgcgcggctcaatcgccctcatgaaagcggcacaggcatacgcgctgctgcatcatcgcgactatgtcataccggatgatattcaatatttagctcctttcacgctgccgcaccggatgatgcttcatcctgaggcaaaatttgaagggattcaggcagaaacgatcgtaagggagatcatgtcagctgtgaaggtgccggttcaaaggtcgtcggtccgctgatgaataagaaatggcaatggctcgtatatggttggaagctgattatattaactttattgacggctgctgttttttcttatgcgatgtttcagggcggctttgtcagctggtttttgttttacgcgtttctcccttttgtcttgtatgccgggctgttggccttgtatccgctccgttcttttcaggcttcaaggcaaatggataaaacacaattgcatgcgggggacaggctgggcgtaacggttacgctgagaagaaagctgccatttcccctgatgtatatggtgattgaagattgcctgccagaaggtatcgagtcattaaatcgagacggagccgcggccaaacggctcgtttttccttggtttaaacggagcataacgatgtcgtatgaattagctcgggtaccgcgcggagagcatcactttcattctgtcagggtgcgaaccggggatgttcttggcttgattgaaaaaactgcattttttgagctggatgataccctgtttgtttatccattctatcagcgtttttcctatcaggtgaatgagaggcatcaggaagacggtgtaagcggttcttctccaattcatgagcaccattcctcagtcgcagcaagtgtgcggaattatcagccgggagaccggtttgctgcgttagattggaagacatctgcacggcggagccagctgatgacgaaggaatttgagccttctcgcagcaaaaatctgtttctgctgatggaccgtttttcctcagacgcatttgaagaggtcgtttcagtgacagcttcgattcttcattctgttttaaaaaacggcgcgggcgctggcctggcttccatcgggaaggaaaaaaacattttccctattcaggaaggggatcagcattttaagcacatgcttcggcatttagccatcgctcattgtgatgcggcagacccgataagccgatatgcacgggaagagctgggaaagccatctgttcgccaagctgatcaagttgttgtcacgggacagttaacggaagatatgctgcacctcgcagaaataggaggcggccgggttacggtgatactggcaaaagagaaagatgctgtgctctctcaagctgaaaatgccatgattgaacgcatgatgaaacgccaaatcagagttcgggtcatgaggggcgggcgagtttcgcgtgttgtttagaaagagaggtgactggttcacatgccgcacgatgatcacaagggaagccgtttgagcttgctgttattttattttctggcttttttattgctgtgggagtggctcaggccgcttgacagttttactgaaacgaaacatacaggcttttttagtgtctttatcggtttgacgtttctgctgacttttttcaggatgaggtggtttgtcacagttcctttttgtgtcatatttacattgatctcgatacacatcctgttttatcaaggatctatattcgacttgagctgggtcagctcttttttgcaggatgtctatctgaatatcacgctgattcaatctgggcaatggaatgacatgattccttcatttcggaccctgctgttttttgtgctgctgtggctgctggtctatctcctgcattattgggtgatttaccagagaagaattttgtttttctttttgatgacagtagcgtatattactattcttgatacctttacgccatatgatgccacttttgccgtcatccgtatcgtgctgatcggcttctttatgctgggccttttatacttggaacgcattaagctgatggaaagaatcacactgccaaaaacatctgtcctgaaatggtttcttcctttatctgtattggttttggctgcaacgggattcggactcgccgctccaaaatcagagccggcctggcctgatccggtgccttttcttaaaaaaatcactcatcaagaccgcgtgtctgcaggggaaagcaaaatcggatacgggaatcatgatgaatcactcggcggcccgttccagcaggatgctacacctgtttttacatggcagggaaaagagcgtacgtatttccgtgtggaaacgaaggacacgtataccggaaaaggatggattgaaacagacacaggcatgtcgtatcagcttagcaatggaaaagttgaaaatctgtggtttgaccataaggttgcgacagagcgccgcaccgtccgtgtaaaagtcgataagcactacgggtataaccatttgatgtatccgattggtgcggaaaccattcagccaaagcaggctgtctcacttgaaatgaacggcaacacggagcaaatttctccgatcagtgaacaagccggtgaaatcagaaatatggggaattatactgtaacgtacaattccccggtctataagctggatgaactgagaaaggtaaaagtgagaaaaaacagtgaggagtacacattcagcgatcgctacatgcagcttccagattcactgccagagcgggtgagaacccttgcgatcaaactgactcaggatcacgacaatatgtttgataaggtgaaagcggttgaggactatttagggtcaaatgcgttcacatatgaaacagaaaacgtgaccattccgaagaatgatgaagattatgtcgatcaatttctctttgaaacgaaaatgggttattgtgataacttttcttccgccatggtggtgctcttgcgctcggccggcattccggcccgctgggtaaagggttatacgtccggcgaatacaaagaagcagggaacaaaaatggcagcatttacgaagtgacaaataacaatgcccattcctgggtagaggtgtatttcccggaacagggctgggttacatttgagccgactaaagggtttacaaatccggctcaatttacttcttctgacacaaaggactccggcagtgataacagcagctcgccgaagaaagcacaagagaaacagaaagaagagaaaaaacagccgcaaaaagaagaaaaacaaaaggaaaaacgggagccagctgtttctaaaaagccgtccgcttcgcatactaatgccggtgcgggcttgtatgcagcgcttgcggttcttgcagtcctcttggtggcagctgtattgctgtatgttttccgctcgttatggattcctgttttcaccgtgaggaaattgaagcggcgcaacgatcagcacgcgttttttgaggcatatgacgcgcttctgaaacaactgaagagaaaagggctgccgaaacgaggcagtgaaacgctgcgtgattatgcaaaacgaattgatgaaaaatacgacatagaagacatgtcaaagctgacattaagctatgaaagggcgctttacagaaatgaagattcttcggcgctatggaatgattcgagagagttatgggaaaatttaattaaaagaagatggtcttgaccgcttatcaacgtgttgttagaattagtgaatattatcggagtctgggagcgagttggcctgactccggcaaacggccttgccaaagagggcggagcgagcttcatatctgtcctcgtttttttctgtgtcaaaaaacttagaggagattaggtgacaaccatgacaaagttagtgaatgaaatgattcttgtccttgatttcggcagtcagtataaccagctgattacacgccgtatccgtgaattcggtgtttacagcgagctgcatccacatacattgacggctgaagaaattaaaaaaatgaatccaaaaggaattattttatccggcggtccaaacagtgtgtatgatgaaaactctttccgctgtgacgagaaaatcttcgagcttgatattcctgttttgggaatttgctacggcatgcagctgatgactcattaccttggcggtaaagttgaagcggcaagccagcgtgaatacggaaaagcaaacatccgcatcgaaggcacacctgatttgttcaaagatcttccaaatgaacaagtggtttggatgagccacggcgatttggttgtagaagttcctgaaggcttcactgttgacgcgacaagccatcactgcccgaactcagcaatgagcaaagcggacaaaaaatggtatggcgttcagttccacccggaagtgcgccactctgaatacggcaatgatcttctgaaaaactttgtattcggtgtttgcgaatgcgaaggcgaatggtcaatggagaactttatcgaaatcgaaatgcaaaaaatccgtgaaacggtcggagacaaacaggttctttgcgcgctaagcggcggcgttgattcctctgttgttgctgttttgattcataaagcgatcggcgaccagctgacttgtatctttgtagaccatggtcttctccggaaaggcgaagctgagggtgttatgaaaacattcagcgaaggctttaacatgaatgtgattaaagtagacgcaaaagatcgattcttaaacaaactaaaaggcgtttctgatcctgaacaaaaacgcaaaatcatcggtaatgaattcatttacgtgtttgatgatgaagcggacaagctcaaaggcatcgactaccttgcacaaggtacgctttacacagatatcatcgagagcggtacagcaacggcgcaaacgatcaaatctcaccacaatgtcggcggacttcctgaagacatgcagtttgagctgatcgagccgttaaacacgctcttcaaagacgaagtgcgcgcgcttggcacagagctcggcattccagatgaaatcgtatggcgtcagccgttcccaggaccgggactcggaatccgtgttcttggcgaagtaacagaagaaaaacttgaaatcgttcgtgaatcagatgcaatcttgcgtgaagaaattgcaaatcacggcttagagcgtgatatctggcaatacttcactgttcttcctgacatccgcagcgttggtgttatgggtgacgcaagaacatatgattacacaatcggaatccgtgccgttacatcaatcgacggcatgacatctgactgggcgcgtatcccgtgggatgtgcttgaagtcatttcgacacgtatcgtaaacgaagtgaagcacattaaccgcgtggtgtacgatattacaagtaagccgcctgcgacgattgagtgggaataagtaaataacaacgagaaaaacgtccctttttcaaaaggggcgttttttttgttaactttttgaaaccgtttcgacaatttttgtatctaacaacataggaggtggataaggtgaaggaagaaagattgattacaaaggcgagaaaaggaaatgctcgggcctttgaaaagcttatgctggcacatcaggagactttatataaaacagcttatctctatttaagaaataaagaagatgcacttgatgctgtacaggaaacagcttataaagcttttatcagtatagaaaaactaaaagagccaaagtattttttaacgtggcttactcgaatattgattcataccatttttgccatgaataaaaagaaaggagatttggttccgtttgagaaacatcatgatgctggaactaatcaagcaaatattgaggaatacatagacttgcgaaatgcgattgatttacttgatgaacatgttcagctcacgattcagctctattattttcaagattattcaatatcaatgatagctgaacaaacaggtatggcagaaggcacaattaaaacccatttacatagagcgagaaaagcattgaaacaggagctggaaaaggaggatcaaaacaaatggacaaacaccaaatgaagcagatgtatgatgacatagcagtgccaaagaaagcactcaaaaaggcaatacatcaagctgtcgttcgtgctgaaaatgaaagtaacacaaggcgccgttttaaatgggcacgaactattacaaatggaatggctattgctgctgtggtaggtatactgtatttaacgtccggtctttttctgccttctgtaaacaaagcgatggggagcatacccattgtcggccaaatttataaggagtttcaagataaagttggtctatcattgtttaaaagcaatctggtcacagctttgaatgaaaaagctgagtcaaggggaatcactgtttcggtaaacagctcgtattacgatgccgggcagcttgtgtataactttactgttgataacctccagtctgatgaaaaagagctcagttataatgtgagtaaagcgagttttaacaataatttttcaatcaactacgattccttaatgctcaaaaaattaaataacaaacaatatgctggtcaattaaggctttatacaaaagggacagaaataaaaaatggggataccgtgccttttgtgattactcatatcaatgaaatacagggaaattggagattcaaactgcctattaccaaaaagaatgcgagttatttagaaagctcaaaagtggtatcagtgcttaacaatcattatcaattttccaatattcaattggagaacggaaagctcggatctgtccttcaatttacaatcgattatcaaggcgtagcaaagcatgatacggttgaaattaacgaagtcaaagatgatttaggaaacacatatgagatgacagcgtcaaacatccaacttggagaccgcaaaaaagtaaacgagagaacggttagagcaaaaggacaaacacagttagaatcaccaattaatccaaaagcgaaaaagctaacattaatagctgatattaaatctgaggcagagggcagtgaaattgtcccgttaaatgcagagatgccatttcatgtttcagaaacaaaccatcaaaacatagggattgaaatcaacaacattaaccaaaaaggaaagaaagtattggttcattaccatttcactggaattgatacctcaagcgtggacgaaaataaattagtgaatatcggtgaaacgattggccttggtgatataaaaaaaatgcaatcttggcctgatccagtaggtgattatgaagaaggttattatttgaaaggaaatattgctaaagtgaaaaatatgaaaacagccgaaatggtatctacttttgagctggatgatgattataatgataagctgtctttaaagcattttgagtttaatgaatacggtctgtatattgataacggtgttttaaatcacctgattcaactaaagccaatctcgtttactgtaccagtgcatcaggtgagtcagcctaccgaaaaaaaataatcataagttgaaaagccgtatgttgccatacatacggtttttatcattgttaccaatttagtcaatagacgaataaaccaatttttttaataagtaatgttcgttgtttatattgtcaattcaaaatgaacttggtacaatagacacagaaatcaaataagatgaattcgtataatcgcgggaatatggctcgcaagtctctaccaagctaccgtaaatggcttgactacgtaaacatttctttcgtttgatataaataaaacacgtttatttattcgaactgaaatccgtctgtagtcaagcgtcccaaaatgtattggggcgttttttatttggcgttttcaggacagaataaatagcaaagagtgaagggagtcaaatagcttgaaaacgttttttcagtttgatgagctgggcaccagctatcgcaatgaaatcattggcggattaacgacttttttatctatggcatatattttgttcgtcaatccgattacgcttgctttggagagcgtgaaagattttccggaggcgctgagaattgaccagggtgcagtctttacagcgacagcgctggcgtctgcagcaggctgtatcttaatgggattaatagcgagatatccgattgccatcgcgccgggtatggggctgaacgcgttttttgcgttttctgttgtccttggtatgggtatttcatggcaggcagctttgtctggtgtttttatttcaggtcttattttcgttgctctttctttaacaggttttcgtgaaaaaatcatcaacgccattccgcctgagctgaaattggcagtcggtgcggggatcggcctgtttattacatttgttggattacaaggttcaggaatcattacagcgaatccttctacgctcgtcacgatcggaaacattcacagcggtcctgtgctgttaacgattttcggtgtgattgtcacggttattttaatggtgcttcgcgtgaacgcaggcgtgtttatcgggatgctattaacagcggtagccggcatgattttcggtttggttccggttccgtctcaaattatcggcagtgtgccaagccttgcgccgactttcggacaagcgtggattcacctcccggatattttctctgtacaaatgctgatcgttattttaacattcttgtttgtcggattttttgatacagctggtacacttgttgctgtggcgacacaagctggtttaatgaaggaaaacaaattgccgcgtgcaggccgtgcgcttttagctgattcatcttctattgtgatcggtgccgtgcttggtacgtctacaacaacttcttatgtggaatcaagctcaggtgtcgctgcgggtgcccgttcaggatttgccgcaattgtaacagggattctctttttactggctacgtttttctctccgctcctatcagtcgttacgtcaaatgtaacagcgccggcgcttattattgttggtgcattgatggtggcgccgcttggcaaaatcgcttgggataagtttgaagtggccgttcctgctttccttaccatgatcatgatgccgttaacgtacagcatcgcgactggtattgccatcggatttattttctatccgattacaatggtgtgcaaaggaaaagcaaaagaggttcatccaatcatgtacgggctgtttgtcgtatttatcctgtactttatcttcttaaaataaggaatgaaaaaccagctgcactggcagctggtttttttgttgcaaaagataaaaccatttcatacgatataccgtcatgtagatgtgccgccatgctttacttaaatggaaatgacttgactgttcaggaaggcttcggtaccttatataagtgttttattttcttgctgaatggtattccgccgtatttttttgataggagttgctgacatgacggaagaaagaaaagaaacgtttgaagaagaaattaaccagagtgaaagaatagatgcagatgaagaaccgctatcgagaatgtccagaaaggcgagccggcaaagcaagcagaagcaaaaacaaaagcagaaaccgcgccaggaacgcggtgaatcaactgttaaagacaagcttgcgtctgtttgggcagccatcaacagatattgcggttttgcgttctcgattttaaaatcaccggcgaaaactgtcgtaacggatggtttttctcattataagtacggtctgatttcaatgcttatattcagtatcattttttcaattgggaattggtttcagttaaaggcaagctggaatcggccgctcggtttcggagaacgccatcatgctttctatgacgggtttttagttgttcttgtgtatttgctgatctttttcgcggtaatggtctttgctatatgggctgtctcccgctatatgatgaagcagaaggtgacgttcagagaagcggctgccgtattgggttcattgcttgtaccggtaattgctgtttcaatcctttggctgatctttgcgatcgtaaatatcccaatgctgacagtactgtttacggtgctgatcttgttttccatcttttttatcatcgcgctgtatgtacagcgtgtgtaccaggcggcacaagatgcaccaattgattatatctattgtgtatttgcagtggttgcgatagcgctgctgtttacggcagtgacttggccgtttatttctgaatattttacggcgtcgctgattccgctttaataaaaaaaccggctaatcctagccggtttttttatgtcacactttttacaaatatatctaaaaaacatagttgatttgtaggattaacccgtgtatgatggggaaaatgctgaaaacgtccagcgcaaaaacctttatgtttaaggaggatgatggacatggctgatgtacttcgccgagcaattaaccaaaagaagcaatttttaaaaaccaaattactgctctcggaattttatcaaggaagaggggaacagcttgctgactacacgctgagtgagcttgagaaagaatacaagtcccttcagaaaatgaaaaaagagatctgacaatagatataaagaggtgagtctgctgaaaagcgggcttttttgttttgattttgaaaaggcgagaaagagggtaaactactactgttcaactcataaaagcatgtcgaaatattttgcttaaacttacgggcgaagctgattgtaaacggctcatttctctagtagaatatgaatgctttgtgcaagctgaagagtagggggatgaataaaatgatgcaaaccatcttatcaaatgggatagccatggttctcataattctcattattaatattgtctatgtgtcattttttacgataagaatgattttaacgctgaaaggacagcgttatttagcggccggcatcagtacgattgaaatactggtttatgtgacggggctgagtctggtgctcgataacttagaccagattcaaaatgtgatcgcgtacgcgctcggttacggtcttggcgtaattgtcggcatgaaaatagaagaaaaattggcgcttggctatattatggtcaatgtgattacgaaggagctcgatcttgatcttccgaagcagctccgtgaaaaaggctacggcgtgacaaattgggtggcaggcgggcttgaaggcgaccgcacagcccttcagatcctgacgccgagaagatatgaactccagctatatgatacgattaaaacacttgattcaaaagcctttattattgcgtacgaaccaaaaacaatccacggcggcttctgggtcaaagcggtgaagaagaggagaattaaagaataatggcaaagccgaagaagaaaaagtttgaagtgacagagcagcaaacgattgatgcggtgcttcagcaaatgaaagaagaaggatatctgcctgtaaggcgaatggaagagcctatttttatggaaaaaaaggaaaatgggtcaattcagatcgttccgtgcgggaaaaaaatcgtatttgaagggaaattgatctaaaacacgaacattagtagaatgaatttttgtatcgttcgataatatcgttgacattatccatgtccgttgttaagataaacatgaaatcaaaacacgacctcatataatcttgggaatatggcccataagtttctacccggcaaccgtaaattgccggactatgcaggaaagtgatcgataaaactgacatggatatatcgcagaagcgaacgactgacgatacatgtaccatgcccggtttgtattgcttcctcataagtgcaatgcagagcgggtattttttattttctgaaaacaaaagcattagaaggtggggaacagaatgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgcgggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaagaccttgcccgtaagctggatgagagaagagaaaatacaaaacagacagtgttagaaagcagtgatcagcttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatgtcgaaattaccgctcattataatgaccgtaaagcgattcgaaaattggcagaaatcagcgatatcatcacatatgagtttgaaaacatcgactatgatgcgctgcattggctgaaagatcatgcgtatctcccgcaaggaagtgagctgctgctcattacccaaaaccgtgaaacagagaaaaaagcaattcaatccgcgggctgtgaagtcgcaccgtacagcatcgtcaaaacaaagaatgaattgaaacaggcggtacaggagctcgggttacccgcagttctgaagacatgccgcggcgggtacgacggcaaaggccaatttgtgataaaagaagaggcgcaaatggagcaggcagccagtctgttagaacacggaacttgcattcttgaaagctgggtttcttttaaaatggaactgtcggtgatcgtcgtcagatcggtaaacggtgaaatttcaacatttccgacagctgaaaacattcaccacaacaatattcttttccaaagcatcgtgcccgcacgggtagagaaagggattcagcagaaggctgctgatctcgcggttaagcttgcagatgagcttaaccttgtcggaccgcttgcagttgagatgttcctgacagaggacggagagcttttggtcaatgaactggcgccaagaccgcacaattctgggcattatacgctggacctttgcgagacgagccagtttgagcagcatatcagagcggtatgcgggcttccgcttgggaagacagatttgctgaagccgggcatgatggtgaatcttctcggcgatgaagtgaagcttgttgaggaagacccggagcttttaaaagaggcaaagctatatatatacggaaaacatgaaatcaaaaaaggccgcaaaatggggcatattacatttatgaagcagcctgaagacgaatggattcaggagatcacaaataaatggatgaatagagatggaggacaagcagaatgatcgaacgttattcaagacctgaaatgtccgcgatttggacggatgaaaacagatttcaagcatggctggaggtagagattcttgcctgtgaagcgtgggcggagcttggcgtcattccgaaagaagatgtaaaagttatgcgtgagaacgcatcatttgacatcaaccgcattttagaaatcgaacaggacacgcgccatgacgttgtcgcttttacgcgcgccgtttccgaatcactgggcgaagaaagaaaatgggtgcactacggattaacgtcaactgacgttgttgatacggctctttcctacttattaaaacaggcaaacgatattttgctcaaggatcttgagagatttgttgacattattaaagaaaaagcgaaagaacataaatacacagtcatgatggggcgcacgcacggcgtacacgctgagcctacaactttcggcttaaaacttgcgctttggcatgaagaaatgaaacgtaatcttgagcgctttaaacaagcgaaagcaggcattgaggttggaaagatttccggcgctgtcggcacatatgcgaacattgatccatttgttgaacaatatgtctgtgagaagctcggattgaaagcagcaccgatttcaactcaaacccttcagcgtgaccgccatgctgactatatggcaacacttgctttgatcgcgacaagcatcgagaaatttgctgtggaaatccgcggactgcaaaagagtgaaacacgtgaagttgaggaatttttcgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcactcttcagcagaacggattattcttccggatgcgacaattgcgctgaactacatgctgaaccgcttctccaacatcgtgaagaacttaacggtcttcccggaaaacatgaagcgcaacatggaccgcacactcggccttatctactctcagcgcgtgctgcttgctttgattgacacaggcctgactcgtgaagaagcctatgatacagtgcagccgaaggcaatggaagcgtgggaaaaacaagtgccgttccgcgagcttgtggaagcggaagagaaaatcacgtcacgtctttctccggaaaaaattgctgactgctttgattacaattaccatctgaaaaatgttgatctgatctttgaacgtttaggtttagcatagaagaagcttttagcggcttcttctaagccgccgcagtttgaaaattcccaacattcgggttaggaggccttccgtgaatattgtgaagaatgaacttttatacgaaggaaaagcaaaaaagatctacaaaaccgatgacgaaaacacgctgtatgttgtgtataaagactccgccactgcctttaacggcgagaaaaaagcagaaatcagcgggaaagggcgcttaaataacgagatttcaagcttgattttcaaacatcttcatacaaagggcattaacaatcactttatcgagcgcatttctgaaacagaacagctcattaaaaaggtaacgattgtgccgcttgaagtcgtcgtcagaaatgttgtggcaggaagcatgtccaaacgtctcggcattccagaaggcacggagcttgagcagccgattatcgagttttactacaaggatgacgcgctgggtgatccgctcatcacagaagatcatatttggcttttgaaggcggcgactcctgagcaggtagaaaccattaagtccattacaaaaacagtaaatgaagagcttcaaagcatcttcgacgattgtcatgtcagattaatagatttcaagcttgaattcggtttagatgcagaagggcaagtgcttttggcggatgaaatttctcctgacacatgccgcttgtgggataaagaaacgaacgaaaagctggataaagatttattcagacgcaatctggggagcttaaccgacgcatacgaagagattttcaaaagactgggaggcattcatcatgtataaagtaaaagtttatgtcagcttaaaagaaagtgtactagatccacaagggagcgctgtccagcatgccttgcacagtatgacttataacgaagttcaagatgtgcgcatcgggaaatacatggagcttaccattgaaaaatctgaccgtgatcttgacgtgctagtgaaagaaatgtgcgaaaaacttcttgcgaacacagtgattgaagattacagatacgaggttgaggaggtagtcgcacagtgaaatttgcggtgattgtgttacccggctccaactgtgatatcgatatgtatcatgctgtaaaggatgagctcggccatgaagtggaatacgtctggcatgaggaaacaagtcttgacggcttcgacggcgtgttaattccgggaggattttcttacggcgattacttaagatgcggcgccatcgcccgatttgcgaatattatgccagctgtcaaacaagcagcggctgaaggaaaacctgttcttggcgtctgtaacggattccagattttacaggagcttgggctgctgccaggcgcaatgagacgcaacaaagatctgaagttcatttgccgtccggttgaattgattgttcagaacgacgaaacattattcacagcttcctacgaaaagggagaatcgattacaatcccggttgcccatggtgaagggaatttctactgtgatgacgagacgcttgctacattaaaggaaaacaatcaaattgctttcacatacggctctaatattaatggaagtgtcagcgacattgccggtgtcgtgaatgagaaaggcaatgtattaggcatgatgcctcaccctgagcgcgcggtcgatgaactgcttggaagcgccgacggtcttaaattgttccagtctatcgtgaaaaattggagggaaactcatgtcactactgcttgaaccaagtaaagaacaaataaaagaagagaaactgtatcagcaaatgggtgtcagtgatgatgagtttgcattgatagaatccattcttggaagattgccgaactacacagaaatcggaattttttctgtcatgtggtctgagcattgcagctataaaaactcaaagccgattctgcgtaaattcccgacaagcggcgagcgtgtgctgcaagggccgggggaaggcgccggaatcgttgatatcggtgataaccaagcggttgtgttcaaaattgaatcccataaccacccatcagctctcgagccttaccaaggcgctgcgactggcgtaggcggaattatccgtgatgtattctcaatgggtgcacgcccaatcgctgtattgaactctcttcgatttggtgaactgacttcaccacgcgtgaagtacttgtttgaagaagtagtagcgggtatcgccggatacggcaactgtatcggcatcccgacagtcggcggagaagtgcagtttgacagcagctatgaaggaaatccgctcgtcaacgccatgtgcgtcggtttaatcaaccatgaagacatcaaaaaaggccaggcaaagggtgtcggcaacacagtaatgtacgtaggagcgaaaacagggcgtgacggcatccacggcgctacgtttgcttctgaagaaatgtcagactcgtctgaagaaaagcgttctgctgtccaagtcggcgatccgtttatggagaagcttttgcttgaagcatgtctggaagtcatccaatgcgacgccttagtcggcattcaggatatgggagctgccggtttaacaagctcaagtgcagaaatggcaagtaaagccggttctggcattgaaatgaaccttgacctgattcctcagcgagaaacaggcatgaccgcgtatgaaatgatgctttctgaatcacaagaacggatgcttttggttattgagcgcggacgtgagcaggaaatcatcgatatttttgacaagtatgatcttgaagcggtttctgtcggacatgtgacagatgataaaatgcttcgcctgacacacaaaggagaggttgtgtgcgagctgcctgttgatgccttggcagaagaagcaccggtttaccataagccttctcaagagcctgcttattatcgcgagtttttggaaacggacgttccggctccgcaaattgaagatgcgaatgaaacgctgaaggcccttcttcagcagccgacgatcgcgagtaaagagtgggtgtatgatcagtatgactacatggtgcgcacgaatacagttgtcgctcctgggtctgatgctggtgttctcagaatccgcggaacgaaaaaggcgctggcgatgacgacagactgtaacgcgcgttatctctatcttgatcctgaagtcggagggaaaattgctgtcgctgaagcagcgcgcaacatcatttgctcaggcgcagaaccgcttgcggtcacagataaccttaacttcggaaacccggagaagccggaaatcttctggcagatcgaaaaagcggcagacggcataagcgaagcgtgcaatgttctcagcacaccggttatcggcggtaacgtatcgctttataacgaatcaaacggcacggcgatctatccgacaccagttatcggcatggttggcttaattgaagatacagcacacattacaacacagcatttcaaacaagcgggagatctcgtatatgtgatcggtgaaacaaaaccagagtttgccggaagcgagctgcaaaaaatgacagaaggccgtatttacggcaaagcgccgcaaatcgatcttgatgtagagctgtctcgtcaaaaagcactgcttgacgcgataaaaaaaggcttcgttcaatctgcgcatgatgtgtctgaaggcggcttaggcgtagcgattgcggaaagtgtcatgacgacggaaaaccttggcgctaatgtgactgtagaaggggaagcggcattattattctctgaatctcaatcccgcttcgtcgtttcagtgaaaaaagaacatcaagctgcgtttgaagcaactgtcaaagatgcggttcatattggtgaggtaacagctgacggaattctggcgattcaaaaccaagacggacaacaaatgattcatgcgcaaacgaaagagcttgaacgcgtatggaaaggagctatcccatgcttgctgaaatcaaaggcttaaatgaagaatgcggcgtttttgggatttggggacatgaagaagccccgcagatcacgtattacggtctccacagccttcagcaccgaggacaggagggtgcgggcatcgtagcgactgacggtgaaaagctgacggcgcacaaaggccaagggctgatcactgaagtatttcaaaacggcgaactcagcaaagtaaagggaaaaggcgctatcgggcacgttcggtacgcaacggctggaggcggcggatacgaaaatgttcagccgctcctcttccgttcccaaaacaacggcagcctggcgcttgctcataacggaaaccttgtcaacgccactcagctgaagcagcagctcgaaaatcaagggagtatttttcaaacctcttcggatacagaggttttggctcacctgatcaaaagaagcggacatttcacgctgaaggaccaaattaaaaactcgctttctatgctgaaaggcgcctacgcgttcctgatcatgaccgaaacagaaatgattgtcgcacttgatccaaacgggctgagaccgctatccatcggcatgatgggcgacgcttatgtggtcgcatcagaaacatgcgcatttgacgtcgtcggcgcaacgtaccttcgcgaggtagagccgggagaaatgctgatcattaatgatgaaggaatgaaatcagagcgtttttccatgaatatcaaccgttccatttgcagcatggagtacatttatttctccagaccagacagcaatattgacggtattaacgtacacagtgcccgtaaaaaccttggaaaaatgctggctcaggaatccgcagttgaagctgacgtcgtaaccggggttccggattccagtatttctgcggcgatcggctatgcagaggcaacaggcattccgtatgagctcggtttaatcaaaaaccgctatgttggcagaacgtttattcagccgtcccaggctctgcgtgagcaaggcgtcagaatgaagctgtctgcggtgcgcggggttgtagaaggcaaacgcgtcgtgatggtggatgactctatcgtacgcggaacaactagccgccggattgtcacgatgcttagagaagcgggtgcgacagaggtgcatgtgaaaatcagttcaccgccgatcgctcatccgtgcttttacggcattgatacgtccacacatgaagaattaatcgcgtcttcgcattctgttgaagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccacgatacagtgcttcctcacgtaaaagaagcagtattaaccaaataaaacttgaaaaatgacataaaggcagcgcagttcggctgcctttctctttctgccctcgttcggggaaatattttgaaaagcgccttaaaggagtgaataggatgtctgaagcatataaaaacgcaggagttgacatcgaagccggatatgaagctgtaaaacgaatgaaaaaacacgtggagcgcacgaaacggcttggcgttatgggcagccttggcggttttggcggcatgtttgacctgtctgagctttcttatcaaaaaccagttctcatttcgggaacggacggtgtcggcacaaaattaaagctcgctttttccatggataagcatgacacgattggcgtggatgctgttgcaatgtgtgtcaatgacgtgctggcacaaggtgcagagccgctgtttttcctcgattatttagcggtcggcaaagcggacccagtgaaaattgaacagattgtacaaggtgttgcggaaggctgtgagcaatcaggttcagccttagtcggcggtgaaacggctgaaatgccgggactctatacagctgatgaatacgatattgccggtttctcagtcggagtggcagaaaaggacgaaatcgtgactggagaaaatatcgaagagggccatctgttgatcggcctcagctccagcggccttcacagtaacggcttttcccttgtcagaaaagtgcttctggatgatgcggagctggacctcgatacaacatatgagccgtttgaacgcccgcttggcgaggaattgcttgaaccgacaaggatttacgtgaagcctgtgcttgccgcggtcaaaagcggaaaaatcgacggcatggcgcacgtgacaggcggaggatttattgaaaatattccgcgtatgcttccggaaggcttaagtgcggaaattgatcatggctcatggccgatcccgccaattttttctttcttgcaagagtacggcaagctaaaggaagaagacatgttcaacgtctttaatatgggtattggttttgttttggctgtcaaagaagagcatctgacagatgtgatcggaacgcttgaaagccatggcgaaaaagcctatttaatcgggcgtgtgaaaaaaggtgaaggcgtcacattcggcggtgcggcactttcatgaaaaagtttgcggtatttgcatcaggaaacggttcaaacttcgaagccatcgtcacgcgtttgaaggaggagaactgggatgcgtcagcagcgctcctcgtttgcgacaaaccgcaggcgaaagtcatcgaacgggcggaagcattccatattccttcctttgcatttgagcccaagtcttatgaaaacaaggctgcatttgaacaagccatcattgaacagcttcgtcttcacgaggttgaattgattgttcttgccggctatatgaggctgatcggtgatacgctccttcaagcatatggaggaaaaatcattaacattcacccgtcgcttcttccggcgtttcctggaatcgacgcagtcggacaggcataccgggcgggtgtgaaggtggctggaatcaccgtgcattatgtcgatgaaggaatggatacaggtccgatcatcgctcaaaaggcaatcgaaattgatgaacatgatacattggaaacaatcgaacagcggattcacaagcttgagcataaatggtatccgagtgtgattaaacagctattaggattaaataacagaggtgaaaaggcatgaccattaaacgtgcgttaatcagtgtttcagataaaacaaatcttgttcctttcgtaaaagaactgacagatcttggcgttgaagtcatctccacaggcggaacgaaaaagcttcttcaagaaaacggtgtggatgtgatcggaatttctgaagtgacaggcttccctgaaattatggacggccggttaaaaaccctacacccgaatattcacggcggccttctggcggttcgcggcaatgaagagcatatggcgcagatcaatgaacacggaattcagccgattgacctcgttgtcgtcaacctctatccatttaaagaaacgatttctaaagaagacgtcacgtatgaagaagcgattgaaaatatcgacatcggcggacctggcatgctgcgtgcggcatcaaagaaccatcaggatgtcacggttatcgtcgatccggccgattacagcccagtgctaaatcaaatcaaagaagaaggcagcgtatctcttcagaaaaaacgcgagctcgcggcaaaagtattccgtcatactgcggcatatgatgcactgatcgctgactacctgacaaatgctgtcggtgaaaaagaaccagagcaattcactgtgacatttgagaaaaaacaatcgcttcgctatggagaaaacccgcatcaggaagcaactttctatcaaacagctcttcctgtcaaaggctccattgcgcaagcagaacagcttcacggaaaagagctttcttacaacaacattaaagacgcggatgcggcagttcaaatcgttcgtgaattcactgaaccggctgcggttgctgtaaagcatatgaatccgtgcggtgtgggaacaggaaaaacgatcgctgaagcgtttgacagagcgtttgaagcggataaaacatctatcttcggcggcattatcgcgctgaaccgtgaagtggacaagacaactgccgaagcgcttcacaacattttcttagaaatcatcattgcgccttcattcagccaagaagcgctcgacgtcctgactgcgaagaaaaatctccgtctgctgacgcttgacgtatccgccgctgttcaaaaagaaaaacagctgacatctgttcaaggcgggctgctgattcaagatttagatatgcacggctttgatgatgcggagatcagcatcccgacaaaaagagagccgaatgagcaagagtgggaagacttgaagcttgcttggaaagtcgtgaagcatgtgaaatcaaatgcgatcgttctcgcaaaggacaacatgacagtcggcgtgggagcaggccaaatgaaccgcgtcggatcggcaaaaatcgcaatcgagcaagcaggggaaaaagcgaaaggcagcgcgctcggatctgatgcatttttcccaatgccggatactgtggaagaagcggcaaaagcgggcgttacggctatcattcagccggggggatctgtgcgtgacgaggattccatcaaaaaagcggatgaatacggcattgccatggtattcaccggcatcagacacttcaaacattaaggggatgaaaacgacgtgaatgtattaattatcggtaaaggcggaagagaacatacgctggcgtggaaggcagcgcaaagcagcctcgtcgagaatgtatttgcagctcctggaaatgacggcatggaagcttccgcacagcttgtaaacattgaggaaagcgaccacgcagggcttgtctcgtttgcaaaagaaaaccaggtcggcctaaccattgtcggccctgaggttcctttaattgaaggtctggtggatgaatttgaaaaagcgggtctgcgcgtgttcggcccgtcaaaagccgcggcgatcatcgaaggaagcaaacagttcgctaaggatttaatgaagaaatacgacattccgaccgcagaatacgacacgtttacatcctttgatgaggcgaaggcatatgtgcaggaaaaaggtgctccgattgtgataaaagcagatggacttgcggctggaaaaggcgttactgtggctatgacagaggaagaagcaattgcgtgtctgcatgactttcttgaagatgaaaagttcggtgatgcgagcgcgtccgttgtcattgaagaatatctttctggtgaagaattttctctgatggcctttgtcaaaggggaaaaggtgtatccaatggtgattgcccaggatcacaagcgtgcgtttgacggagacaaaggcccgaatacgggcggaatgggcgcttactctccagttccgcaaatttcggaagaaacggtccgccatgctgtagaaacgatcgttaagccggccgcaaaagcaatggtacaagaaggccgttccttcactggcgttttgtacgctggattgatgcttactgaaaacggctcgaaggtcattgaatttaatgcccgtttcggcgatccggaaacacaggtcgtgcttccgcgcatggaatctgatctggtacaggtgcttcttgatcttttagatgataaggaagttgacttaagatggaaggataccgctgctgttagtgtggtgcttgcttctgaaggatatccggaaagctacgcaaaaggcacgccgatcggcagccttgcagcagaaactgagcaggtcgtggtcttccatgccggaacgaaagcagaaggcggagagttcgttacaaacggggggcgcgtcgccaatgtgacagcttttgatgaatcgtttgaagcggctagagaccgagtgtacaaagcggttgatgaaatattcaaaccgggactctttttcagaaaagacattggggcacgcgctttaaaggctgcccaaaaataactgaggaaaacccgcagattagctgcgggtttttttgttatcaaaaagcgggatggcagctggaagaagaaagcacaacgagtgtggttggttttccatgggccatcgaggcgtcaataaaatcctcaagcgtatgtaccgattcagtcacgacctttgtcacatagctgtacatccctgtgatgcggtgattttctgctacatcaggatgcgatgttgcaaaggcggcgtagtgcttacagctttttggctccatgagaataaaagcggtgacatgcttgtttagtttttcgtaacagatattcgcgctgtagccggtaatcactcctttgtcttcaagcttcctgacacgctccgccgcgcttggcgaactgagtccgacaagctttcccagctcaaccatcgttaatctgccgtttcgctgcaaatgcgagagaatctgaaggtctgtatcgtccatttgtccggctcctttacatatttaggcgaatgaatgaaaattcctttgatcataaggcaatgctgttgacttaccttcattgtagcatatggatgccgtcttattttttctataataaagccatcaatcagagaggaggcatcatgttgccagaattacagcgctctattacttggatacaagggacggcgttaacgattggggcggttttaggatgcgggatattaattttgccgtctgttaccgcggatacggccggtccggcttctttatttgtctgggtattcatgtcttttttatcttttcttctcgtcggcacgctggcacggcttgtgaaaattgcgcctagtgcgggaggaatcactgcttatgtgcagctggcctttcagaaaaaagccggggctattttgggctggatcatgttagggtccgttccgatcggcgttcccatcatcgctttgactggcgcgcattacgtcagttacgtcacagaggcggccgattggcaggttacatcgattgctggttgtatgctggctatatctattttgcttcatatgaaagggattcaactatcagcaaacatcagtacactcgtcatatgtgtcatcgtatttctgcttgtcacttctattgctgtgtcattgccacacgtcacgatagcagaattcaagccgtttcttccgcatggctggtctgttgctggatctgtttctgttatgatttttttctcttttataggctgggaaatgattactccattggctgaggaatttcatcgccctgaaaaagatgtcccaatcagcttgttcttgggagcgtcttgtgtggcagggctgtatatcatgctgtcatttgtgacggtggggactcattcatatggagagaatggagaaattgcatcgctcgccatgctcatctcaaaaggagcaggggaaagcggtgtatacgtcacggtatgtttagcgctgtttattacattcgccaccatccatgccaatattgctggtttttcaagaatggtgtatgcattggcgagagaggggcacattcctgtatattttggaaaactcagtgcgacaaaacgtacgcctattcgcgttttgacagcgatggccgcagtgtttggcttagtgcttgcggcgcatggcctgtttcaaatcgatttgacgactctgttgaaagggccgagcgcggcttttatcgcatcttacatatgtacaatggcggcagcactgaaactgctgggcaggagagatataggctggtggatggcgctcggggcatttgcggcgtgcgcggtgatttattcattcagcggctgggccctgctttatccggcagtgctggcagctgcaggatatttctatatgaaaacaaagggtgggcataaaaaaaagcttgatcacgttttgtgatcaagcttttccatttatccgttttgatgctcgttatttccagaatcgctgtgttgaaacatgtaggtcacaggacagaagcgcaagattcccgaacccgctttcatggcccccataaagatgtaaaagagatgcattctgcaccaaggttttttcgtaaactttgcactggcggctgacataatcgttaatccgcaggcgattctgaaaacggcattgatgagactgatgtttggcttcaaggaaatccgctccttttacttaaaaaagttttttaatcgaaccttcaaaaatttgtaacgtttttatcgtgcgtgatgaggaaggatgtgataccatgagtctaatacatgtaaaggagagtatgtgaatgtccgaacgcacctttaactggaaaaacaaagacatcagggcacaggttgatgttgtagactcaaagctgcttccaacgctccttttacggaatgctctcgtcttaaatccatatgtaaaacaatggctgaaaaaaaacatttggatttatcaggaccgcattgtttatgtgggtcatgaacttccgaatagagccgaagaaattcatacgattgattgtgaaggaaaatacattgtgccaggttatattgaaccgcacgcacatccttttcaaatatataatccccaaacactggcggaatatgtgtctcaatacggaacaacgacattcgtgaatgataacttatttttgcttttgcaaagcggaaaaaagaaagcgcttacgattttgaatgaactcaaaaagcagcctgtccagtatttttggtggtcacgctatgacctccagacagaggttctgaacgaggaccacgtccttccatttgacgtcagaaaacagtggattgaacatccggatgtgattcaaggcggagaaatgaccggatggcctcgcctggtagatggtgatgatttaatgctccactgtatgcaagctacaaagaaacagagaaaacgcattgaagggcattttcccggcgcttctgataaaacgcttacaaaaatgaagctgttcggagcggattgtgatcatgaagcgatgacaggtgatgaagtgatgagaaggctggaactgggctattatgtttcccttcggaactcttccattcgccctgatgtaagaaaaatcttgcaggagctgcatgagaagggcttccgctattatgaccacttctttttcacgacagatggcgcaaccccgaatttctataaaggcggcatgacaaacgagctgattcgcatcgcgttagaagaaggcgtacctgcaatcgatgcctacaatatggcatcatttaatatcgcaaagtattaccaaatggatgattatttaggagttgtcggaccgggcagactggcatcgctgaacatattggaagatccgttaaatccgaatcccgtgactgttctgtcaaaagggaccattctgcgtgaagacggctgtgatttgaaggcgtttacaaagacggactggcacaaaggcggtcttgtcccgcttgagctttcatatgatatgacgatggatgacttgcagttttctatgccgatgggcgtgaaaatgcggaatgcggtcattatggagccgtatatgattgagatcgacaattcgatggaacagctctcgtttgaccatgatgaaagttatttgacgatgctcgacagacacgggaaatggcgcgtcaatacgatgataaaagggtttgcctcaagcgtgcagggatttgtaagctcctttacgacgacgggcgacattgtcgcgattggaaaaaataaagcggatatgctgctcgcttttgcccgcatgaaagaaatcggaggaggaattgttttagcggagaacggaaacattctgcatgaaatcccgcttgcgctgtgcggctgcgcctcttcggaagcgtatgaagacgtgcttgagaaggaacaaaagctgagagatcttttgactgaaagaggctatgagttttgcgatcctatctatacgctgctctttttacaaagtacgcaccttccgtatatacgcattacgccaagaggaatcttcgacgtcatgaaaaaaactgtactctttccatcgataatgcgttaaaatataaaagagcagggagccgacatatgaaaaaatggatgacagtttgcgcgctgtgtttcgtgttttttctgctggtatcctgccagcagaaggatgctgtcccggatactgcaaagaagctgaaagctcctttaacggggctaaagagtgaacagaaggtgactgaacgccggcctgttgctgttgtggtgaacaatcacccgaaggcgaggccgcagtcgggtctgtctaaagccgacattgtcatagaagcgctagccgaagggcaaatcacaagatttctggccattttccaaagccagatgcctgaaactgtcggacctgtgcggagcgcgcgggaatatttcgtcactctcagcaatggctttgacagcatatttgtccatcacggctggagtcccggcgccaaagagcagctggaatccggagctgccgattatatgaacggattggattttgacggaagcttattttggagagctgatttcagcaaaccgccccacaattcctatacgtcttatgattacataaaaaaggcggcagaacaaaagggttataagttgaagcaggaaacaaatccgctgctgtttcaaacatcagatgcaaaacctgcaaatgaatcttacaatgttcgggtagattatggaacaaataacgttacaaatcttgtcgaatacaactatgataaaaaagctgaatcttatacaagaagctctgatggtgtcataacgacagaccgggaaaccggaaagccggttgcaatgcaaaatattttcattgttgaagccagccatcatattattgatcaagatggaaggcgggacatcgacttggaatcagggggaaaaggtctgttgtttcagcacggaaacgtcattgaaacagactggaaacaagtgaatggcagaattgtgccggtaaaagacggcaagtggcttccgtttgtgccaggaaagacttggatcaatatcgtacctgatcttgatgcggcttccattagtaaaggagaaggtgtgtaacgatgcaaatcgataaattacgcggcaaagagctggaccagttatttaactcgatcttatcgctgaaagacctggaggaatgttaccgattcttcgatgatctatgcacaattaacgaaattcaatcgctggctcagcgccttgaagtggcgcgcatgcttcgcgaaggaaacacgtatcataagattgaaacagaaacaggcgcttccacggctacgatttcccgtgtgaaacgctgcttaaattacggaaatgacgcttatgaaatggcgcttgaccgtgtgaaagagacggaaactgagtcttcttcaaaataataaacaaccgccctgccgttcggcaagggcggtttctttatgaaacaaattggtgaatcaggttgtcgatatcgatgatactgccatcctctttccgatagacaacatgctccttggaaaagtgaatcggcgaattgatccctgctgcggctgcaagattaaacagcccctcgcgcagggaaatgacgtagttgcagacacgatgctgtttttcctcaacgctttttgcaatttcggatctgtcgtcgccacacctgccggacaggtgttggtgtggcagacgagagcgcggatgcagccaacggaaaacatcatgccgcgtgcgatgttgacaaagtcagcgccgagggctaaggcaaccgcgattttatcaggagtcaggagttttccggaagcaaagattttcagctggctgcgcaagccgtattgtttaagaagcgtgtcaacaataggcagcgctgtcataattggaaggccgactgtatccgcgagctcgtaaaaggaagctccggtaccgccttcacttccgtcgatcgtgataaaatccggatgctttccgcttttctgcatataagagaaaagctcatgcaattcttcaggatgccctgcgaccagtttgatgccgactggcttttgtccgacatctctaagtttttcaataaagtcgagcatttcaggagggtttgagaattcataaaagcggttcgggctgtcaatcgactttccaggttcgacattccgaatatctgccacttcctctgatactttggcgccgtccacatggccgccgcgggttttcgctccttgtgccagctttagctcaaacgctttaatctggtcaatcctgctttttcttttaaattcctcccatgaaaattctccgtttcttttgcgcacgccgaataggcccggaccgatttggcaaatgatatcggcgccgccctttaagtgatactcagacaatcctccttcacctgtattcatccaggttccgcctgcctgatggagcccttttgagagcgccgtaacagcccgttctccaagggaaccgtagctcatggcagactggccgactaatcccttcacataaaatggcttctcgcatgtatgctcgccaatcacctgtacatcatcaggatggagaaaatacgggtctgccttgatatgttcggcatgctccttgcgtttgaatagattgtcagcatccattttatagatttgggtttcaatttttggcgtttgatttacgtgcatttcttccctttgttttggaaacatagcgttacggatataatagccaggtttatcaaaatctcttacagatccaaagcccatcattctgcttttgtatttgccggagatgacggtttgctcatattcctttcgtgaaaatggctgctcctcattgtcattgctgtataaatactgtctgagctccggcccgattttttcaaggatataccgaaaccttccgatgacgggatagttgcgaagaattgagtgctcctgctgtttttcatcctttatgtagatccaggcaaacaagacgatcgggatagcgatgatcccaatgataaatgcgatgagtgctattatgatggtttccatctctcagcctccctttttatgtaaccatttccacagtagaacactttccaaacaatagcagaaggaatctggtgaaaaatgtgtgctcctgccgatacaggactcaccatgcaggtactgccctatgctctctttttttatgaaaatagaatcaaaacacctttttcagtgaataacgagattaacggctttttccgtttttccgcgctatgtgaatttgttataatgtttaaatggtaacaaacgaatggaggaacgtatgacgtgtacgatgtaacagagtggaagcatgtctttaaactcgatccaaataaagatttgcctgacgaacagctggagattctttgcgaatcaggaacggatgcggtcattatcggaggcagtgatggtgtgacagaggataatgtcctgcggatgatgtctaaggtaagacggtttttggtaccgtgtgtccttgaggtatcagcgattgaagcgatcgttcccggctttgacttatattttattccgagtgtattaaacagcaaaaacgcggattggattgtcggaatgcaccagaaagccatgaaggaatacggagaactgatgtctatggaagaaatcgtggcggagggctactgcatcgcaaatccagattgcaaagccgcggcactgactgaagcggacgccgatctgaatatggatgatattgtcgcctatgcgcgtgtgtcggagctgctgcaactgccgattttttatttagaatacagcggcgtgcttggagacatagaagctgtcaagaaaacgaaggctgtattggaaacgtccaccttgttttacggcggcggcatcaaggatgcggaaacggccaagcagtacgcagagcatgcggacgtgatcgttgtaggcaatgctgtgtatgaagatttggacagggctttgaaaacagtagcggctgtgaaaggcgagtagtaaattgtacggatttggtttatgatagaacatatgttttgtataggcgggtgaacaaattttgaattatattagcaatcaattactaagcggtttaaaccccgttcagcaggaagcagtcaaaacaacggacgggccccttttgctgatggcgggagcgggaagcggaaagacgcgtgtcctgacacacagaattgcttatttaatggcagaaaagcatgtggcgccgtggaacattctggcgatcacatttacaaataaagcggcacgcgaaatgaaagaacgtgtggaaagcatccttggacccggcgcggacgatatctggatttccacattccacagtatgtgcgtgcggatcttgcgcagagatatcgaccggattgggatcaaccgaaatttctccatccttgatacggctgaccagctttcagtgatcaaggggattttgaaggagcgcaatcttgatccgaagaagtttgacccgagaagcatcctcggcacgatcagcagtgcaaaaaacgaattgaccgaaccggaggaattctctaaagttgccggcggctactacgatcaggtggtcagcgatgtatatgctgattatcagaagaagctattgaaaaaccagtcgctcgattttgacgatttgattatgacgacgattaaactgtttgacagagtgccggaagtgcttgaattttatcagcgcaaattccagtacattcacgttgatgagtatcaggatacgaacagggcgcaatacatgctcgttaagcagcttgccgagcgtttccagaacctttgcgttgtcggggattctgatcagtcaatctacagatggcgcggcgcggatatcaccaacattctttcatttgaaaaagattatccgaatgcaagcgtgattttgctagaacaaaactatcgttcaacgaaacggattttgcgcgcggctaacgaggtcattaaaaacaactctaaccgcaaaccgaaaaatttgtggacggaaaacgatgaaggcatcaagatttcctattatcgcggtgataatgagttcggtgaaggacagtttgtggccggcaaaattcatcagcttcacagcacaggcaagcggaagctgtcggatatcgccattttataccggacaaacgcgcagtcccgtgtgattgaggaaacgcttctcaaagcgggtttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggcttgtcctttttccaagcgattcagcaggttgattttatcggcgtcagtgccaaagcggcaaacgcgcttgacagctttagacagatgattgaaaacctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgtaacgaaaaactttgaacagaaaagtgaagacaagacactcgttgcgttcctgacagacttggcgttaatcgcagatattgatcagctcgatcagaaggaggaagagtcaggcggcaaggatgcgatcaccctgatgacactgcacgccgcgaaaggactggagttcccggttgttttcttgatggggcttgaagaaggcgtcttcccgcatagccgttcactcatggaggaagcggaaatggaagaagaacgccgccttgcgtacgttgggattacaagggctgaacaggagctttatctgaccaatgctaaaatgcgcaccttgtttggccggacaaatatgaacccggaatctcgcttcattgctgaaataccggatgatttattggaaaacctaaatgagaaaaaagaaacgagagcgacgtctgcgagaaaaatgcagccgagacgcggccctgtttcacgccccgtatcctacgccagcaaaacaggcggcgacaccttaaactgggcagtcggagataaggcgggccataaaaaatggggaacaggaactgtcgtcagcgtgaaaggcgaaggagaagggacggagctcgatattgccttcccgagccctgttggcgtgaaacgcctgttagcagcatttgctcctattgaaaagcagtaatcgaagaggaaaggaagaagcagatggacaaagaaacagcgaagcagcgggcagaagaactgcgccgcaccatcaacaagtatagctatgaatattacaccctagatgaaccgagcgtccctgatgcggaatatgacagattgatgcaggagctgatcgtgatcgaggaggagcatccagacctcagaacgcctgactctcctacgcagcgcgtcggcggagccgtgcttgaagcgtttcaaaaagtcacccacggcacaccgatgctcagtctgggcaacgcctttaatgctgatgatcttcgtgatttcgaccgccgtgtgcgccaagccgtcggcgacgatgtggcgtataatgtggagctgaaaatagacggtcttgctgtttctctccgttatgaagacggctattttgtcagaggagccacccgaggtgacggaacgacgggagaggatattacggagaatctgaagacgattcgcaatatccccctcaaaatgaaccgtgagctgtcgatcgaagtgcgcggcgaggcgtatatgccgaagcgttcgtttgaagcactcaatgaggaacggattaaaaatgaggaagagccgttcgccaatccgcgaaatgccgcggcaggatctctcagacagctcgatccgaaaattgcagcgaaacgaaacctcgatatcttcgtctacagtatagcggagcttgacgagatgggtgtggagacgcaaagccaagggcttgattttctcgacgaactcggatttaaaacgaatcaggaacgaaaaaaatgcggcgacatagaagaagtcattacgctgatcgatgagcttcaggcgaagcgcgctgacctgccgtatgaaatagacggcattgtcattaaagtcgattctctcgatcagcaggaggagctcggttttacggcgaaaagcccgcgctgggccatcgcgtataagtttcctgctgaagaggtcgtgacgaagcttctcgatatcgaattaaatgtcggcagaacgggtgtgatcacgccgaccgcgattcttgagccggtaaaagttgccggcacaacggtctcaagagcatcccttcataacgaagatttaattaaagagaaggacattcggattttggataaggttgtcgtcaaaaaagcgggcgatatcatcccggaagttgtgaatgtcctcgttgaacagcgcacaggagaagaaaaggaattcagcatgccgacggaatgtcctgaatgcggcagtgagctcgtccggatcgaaggagaagtggcgcttcgctgcattaaccctgaatgtccggcgcaaatccgggaagggctgatccatttcgtttcccgcaatgccatgaacattgatgggctcggcgaacgagtgatcacacagctgtttgaggaaaaccttgtccgcaatgtggcagatttatataagctgacgaaggaacgagtcatccagctcgagcgcatgggcgaaaagtccactgaaaacctgatcagctccatccaaaaatcaaaagaaaattcgttagagcgcctgctgtttgggcttggcatccgttttatcggatcaaaggccgcaaagacgcttgccatgcattttgaaagcttggagaacctgaaaaaagcctctaaagaggaacttctcgcggtagatgaaatcggtgaaaaaatggctgatgctgtgatcacctattttcataaagaagaaatgcttgaactcttgaatgaacttcaggagctgggcgtaaacacgctctacaaaggcccgaaaaaagtaaaagcagaggacagcgactcttactttgccggtaaaacaattgttctgacaggaaagctggaagagctgtcaagaaacgaagccaaagcgcaaatcgaagcgctgggcggaaagctgactggaagcgtcagcaaaaacacagacttagtcatcgccggagaagcggcgggaagcaagctgacaaaagcacaagagctgaacattgaagtgtggaatgaagaacagttaatgggagagctaaagaaataagaggagtgttttctattgaaaaagacgttggcattggcggcaacggcggcagtattaatgctgtctgcctgctcgtcaggttttgggggggagaaggaggaagagattacgcaaaagacggcgaaatcgtcagaaaaagcgattgtcccgaaatataatatctctgactcctattacaaaatggtgctgccgtttaaggcaggcaaagcgcgcggcttaacaacggaacagctgaacactaggctggacattgacgagtttgaaacagggctgatgcgtcttgcccaagattctttctcgactgacgattatctgttccaagaaggacaatatttagatgaggatacagtattaagctggctggcacggaaaaaaacgggctctgatttgaaaaaagccgaaaaagaagataagaacttcaaaaatgaaggcttgaacccggcgctcccgagttctggttcaacagaagaaaagaacgaaagcagcccgatttatttagcatccatgcttgagcacgattatttagtcagaaaagacaagaattctatccagcttggcggcgtcatgatcggactggcgttaaactccgtgtattactatcgtgaaaaaactggcgacccgcaaaaagaagtggagattaaggacagcacgctccgccagcagggagaaaaaattgcacaggaggttattaaccgcctccgtaaaaaagataacttgaagaatgtgccgattaccgtcgcactctacaagcaggcgtcaaaaacatcgattgtgccggggaacttcatcgccaaaacagaggtcaaagcaggctctactgatatctcaaattgggatgacatcaatgaaaaatatgtattctatccggcggatacaaccacagcagaaaagtacccggatgacaccgaggtctttaagcggttcaaaaactcaattgaagaatatttcccgaactatacaggcgttgtcggtacagcgctgtatgaaaatgatgaaatgaagaaaatgaagattgacataccaatgcaattctacggaaaaagtgaagttgtcgcgtttacccagttcttaacgggtgaagtgatggactactactctaagagctcagttgatgtcgaagtcaatatcacgtcctcagacggacaggaagcggtcattatccgcaatgctggagataaagagccgactgttcacatttatgactgatagaaaacccttgtgccatattggcacaagggtttttatgttataattaacaggaaaagggaaaatatttccgcttctgccgaaacacaaatcaaggggaggtatgttgatgctggaaatcgtgtgaaaacaatcattatcaaatctatagcaatgaaaggatgttagacatgcataaagatatcaaaaaaatatttgaggaagagcaggttttggcagaagctgcagcgagatacggtttctcaaaagatcaggtgcgttttctggctgatgcggaaaactatgtatatgaatgtatgaaagacaatcaaccttatattttaaagattacccatacgattcggagatcttctgattatataatgggagagatggaatggctccgtcaccttgcaatagggggaatttcagtagccaaaccgctcccatcgctgaacggaaaagacgtagaagcagtgccggacggaaacggcgggtcatttttattgagagtgtatgagaaagcgccggggcaaaaagtggatgaatcggactggaatgaaacgctattttatgagcttggcagatacacaggcagcatgcacagcctgacaaaaagctacaaattgagcaatcccgctttcaaaagacaggaatgggatgaagaggagcaattaaagctgagaaaatatgtgcctgaagatcagataaaggtgtttcagcaagccgattctttgatgaatgaactgcggaggctcccgaaaagccaggacagctacggcttggtgcatgcggatctgcaccatggcaattttaactgggatcatggcaaaatcacggcatttgattttgatgatatcggctacaactggtttgttaacgatattagcattcttctctacaatgtcctgtggtatcctgttgtgccatatgatgataaagctgcgtttacagaagaatttatgacgcattttatgaaagggtactgggaggaaaatgagcttgaccctgcatggctgatgataatacctgatttcctccgccttcgccatatgctgatttacggattgctgcatcagatgtttgaccttaacacaataggagaagaagaaaaagaaatgctggccggtttcagaagagatatagagaatggcacgccgattacagcatttgatttttcagcactggtgtagatagaaaaagccaatgggattccagtcccattggcttttataatgtatcacacttcacgccgactacgccttcaatggctttaatgtcatagtagacatcggtcgtatatctgtttttatggacgcggaccttcacttccataattggaaaatccttttcgcctaggtcgtcgatccgaacggagtgtgctttgatatctcttcttttcatttcttttaaaatctctgtcattttgtctttatcagaaagtgacattctgatgcggatgtctttttcctgcaggcggtcggggccgatttttctgaccacccatgggagaaattccacgctgatcaggatgaacagaagactggcaaacgcttctttataaaaaccggctcccgtagcaagcccgagccccgctgccccccagatcatggccgatgtcgtcaggccggaaatgacatcattgctttttcgcaggatgacaccggcgccgataaacccgacgccggagatgatttgtgccggcagacgaagtggatccatcatgatgcggtagtatttagggaaatgatatgccgcattaatactgacgatcgtcagcatgcatgagctgactgcgatgacaatacaggtttttaatccgagcggcttattttttaattcgcgttcaagcccgatgaccatgccaatcaatgtggcaatgcccaatttcaataaaatatcaggatcaatataccagctcaacagcaaacttcccccttctctatggtgtttttaaataaatatgattttctcacagtatttatagcaaaacaagggcacaaaagccaccaagctgcgcttgatggcttattgcttactttttgcgttttaacagcttttccatgacaccgaataatcggtaagaggcttttgcaggacgttttgtgatcatgctgacaatgatgccggcaatcatactgagaataaacccagggatgatttcgtacacaccggttgattttgccaggccggttgtaatccagatcaacacggtcgcagccccgacaatcatggcagcaagcgcgccccattcgttcattcgcttccaatacagactgagcagaatcgcaggtccgaaagctgaaccgaagccggcccaagcgtatccgaccaaatcaagaatggtgctgttcgggttcaatgacaagagtaccgcgataacggcaatgactaagacggacaatcgcccgatcatgaccaattctttatcagaagcttttcgtctgaaaaatgaccggtataaatcctctgttacagcacttgctgtaaccaagagctgtgaggaaatcgaactcatgatggcagccaaaatagctgacaataagaaccctgtaattaatgggtggaacaagattttagagaagataatgaaaatcatctccggatcttttacagcaactccgaatttatgggcgtatgcaacaccgattaaacccgtcagcacggaacctagaactgtaatgatcatccagctcatgccgattcggcgtgcaggcttcaaatctttaatgtttttgatcgccataaatcggacgatgatatgaggctggccgtagtagcccaagccccaggctaaataggaaataatgctaatgacgctcgcgcctttaaaaatatccaataagtgtgggttaacagcgccgatttcatggagagtcggagcaacgccgcccacgtgggtaaaagcaacgatcggcacaagcactagtgctgcaaacatgatcgcaccctgcacgaagtcagtcagactgacagcaaggaaaccgccaaacagtgtgtataatacgacaactgcggtggtcagaaacaagcctaatttgtaatccgcaccaaaagcagattcaaacagccgtccgccagataccataccggaagaggtatacaatgtgaaaaagatcatgatgatcaatgcagatacgattttcagcagtgatgaagaatgctggaatcgtttatcaaagaaatcaggaatcgtaatcgcatcatccgccgcttctgtataagcacgcagccttggagccagcagcaagtaatttgagtacgccccgattgtaagacctaaagcaagccataaggtggacagccctgtcgcaaacatcgcgccgggaacacccatcagcatccatccgctcatatcggccgcgccggcagacaaagcagtaacgaatggtccgaggcctcttcctccaagcatgtaatcattgatgtcagtggttttcttgaatgcataccagccgattaacagcatggcaataaagtaaattcctaaagatataataatttcaatactcacgttttaccctctcttcatttctaataatgttgcatcacctctcaaattgatggtgccagttaagcagcctggcgtaagtgcaaaacaaaagaaattcttttgcgggtgcacttggtaacttaacctaacaaagtattcccggccattcaagcgatgaaacattgatcataagctggaaataccgttgcaaacctagaagggaataaagaataaaacgctttcaaaaaataattaaagtaaaaatattcagaaaaatatttcgtttctccttctcctcattttagtataaaatatatagggtattgtttcgaaaacacaggcctgtctcaaggcgttttgttgctttaaagggcttgtttttgatatgatcagtattatatgacttaacggagaaatatgtggaggtggatcatatgtcacgaatttcaatagaagaagtaaagcatgttgcgcaccttgcaagacttgcgattactgaagaagaagcaaaaatgttcactgaacagctcgacagtatcatttcatttgccgaggagcttaatgaggttaacacagacaatgtggagcctacaactcacgtgctgaaaatgaaaaatgtcatgagagaagatgaagcgggtaaaggtcttccggttgaggatgtcatgaaaaatgcgcctgaccataaagacggctatattcgtgtgccatcaattctggactaaaggagggacacaagaatgtcattatttgatcataaaatcacagaattaaaacagctcatacataaaaaagagattaagatttctgatctggttgatgaatcttataaacgcatccaagcggttgatgataaggtacaagcctttttggcattagatgaagaaagagcgcgcgcatacgcgaaggagcttgatgaggcggttgacggccgttctgagcacggtcttcttttcggtatgccgatcggcgtaaaagataatatcgtaacaaaagggctgcgcacaacatgctccagcaaaattctcgaaaactttgatccgatttacgatgctactgtcgttcagcgccttcaagacgctgaagcggtcacaatcggaaaactgaacatggacgaattcgccatggggtcatctacagaaaactcagcttacaagctgacgaaaaatccttggaacctggatacagttcccggcggttcaagcggcggatctgcggctgcggttgctgcgggagaagttccgttttctcttggatctgacacaggcggctccatccgtcagccggcttctttctgtggcgttgtcggattaaaacctacatacggacgtgtatctcgttacggactggtcgcatttgcgtcttcattagaccaaatcggaccgattacacgtacggttgaggataacgcgtttttacttcaagcgatttccggcgtagataaaatggactccacgagtgcaaatgtggacgtgcctgattttctttcttcattaactggcgacatcaaaggactgaaaatcgccgttccgaaagaataccttggtgaaggtgtcggcaaagaagcgagagaatctgtcttggcagcgctgaaagtccttgaaggtctcggcgctacatgggaagaagtgtctcttccgcacagtaaatacgcgcttgcgacatattacctgctgtcatcttctgaagcgtcagcgaaccttgcacgctttgacggcatccgctacggctaccgcacagacaacgcggataacctgatcgacctttacaagcaaacgcgcgctgaaggttttggaaatgaagtcaaacgccgcatcatgcttggaacgtttgctttaagctcaggctactacgatgcgtactacaaaaaagcgcaaaaagtgcgtacgttgattaagaaggatttcgaagacgtatttgaaaaatatgatgttattgttggaccgactacaccgacacctgcgtttaaaatcggtgaaaacacgaaggatccgctcacaatgtacgcaaacgatatcttaacgattccggtcaaccttgccggcgtaccgggaatcagcgtgccatgcggattagcagacggtcttccgctcggcctgcaaatcatcggaaaacactttgatgaaagcactgtataccgcgttgctcatgcatttgaacaagcgacagaccatcataaagcaaaacctgaactgtaaggggtgaaaagaattgaactttgaaacggtaatcggacttgaagtccacgttgagttaaaaacaaaatcaaaaattttctcaagctctccaacgccattcggcgcggaggcgaatacgcagacaagcgtcattgacctcggatacccgggcgtcctgcctgtcctgaacaaagaagccgttgaattcgcaatgaaagccgctatggcgctcaactgtgagatcgcaacggatacgaagtttgaccgcaaaaactatttctatcctgacaacccgaaagcgtatcagatttctcaatttgataagccaatcggcgaaaacggctggatcgaaattgaagtcggcggcaaaacaaaacgaatcggcatcacgcgccttcaccttgaagaggatgccggaaagctgacgcatacaggcgacggctattctcttgttgacttcaaccgtcaaggaacgccgcttgttgagatcgtatcagagccggacatccgcacgccggaagaagcgtacgcgtatcttgaaaagctgaaatccatcatccaatatacaggcgtttctgactgtaaaatggaagaaggctcacttcgctgtgacgccaatatctctcttcgtccgatcggccaagaggaattcggcacaaaaacagaattgaaaaacttgaactcctttgcgtttgttcaaaaaggccttgagcatgaagaaaaacgccaggagcaggttcttctttcgggcggcgtcatccagcaggaaactcgccgttatgatgaagcaacgaagaaaaccattcttatgcgtgtcaaagagggatctgacgactaccgttacttcccagagccagatctagtcgagctctacattgatgatgaatggaaggaacgcgtaaaagcaagcattcctgagcttccggatgagcgccgcaagcgttatatcgaagagcttggcttgcctgcatatgacgcgatggttctgacgctgacaaaagaaatggctgatttcttcgaagaaaccgttcaaaaaggcgctgaagctaaacaagcgtctaactggctgatgggtgaagtgtcagcttacctaaacgcagaacaaaaagagcttgccgacgttgccctgacacctgaaggccttgccggcatgatcaaattgattgaaaaaggaaccatttcttctaagatcgcgaagaaagtgtttaaagaattgattgaaaaaggcggcgacgctgagaagattgtgaaagagaaaggccttgttcagatttctgacgaaggcgtgcttctgaagcttgtcactgaggcgcttgacaacaatcctcaatcaatcgaagactttaaaaacggaaaagaccgcgcgatcggcttcctagtcggacagattatgaaagcgtccaaaggacaagccaacccgccgatggtcaacaaaattctgcttgaagaaattaaaaaacgctaataaaaaagcagcccttagaggctgctttttttatggtcaaattgagataaagacagagatgagagcacgaagcctttcaacttctttgtcgttggttccggtcaaattggacagcatgcctttaataatcggcttgcgcggtttatcctgagtcaattcttcttcgataacatcaagtgacacggtgatatcctcgggcagcgtgctgttttctttcactttctgaatgtcctcaagcagctggtctttccccgcaggcatcgggttgaaaatgtcttttgacacaatcggattgagtgcagaacggctcagcccctgtacaagatcatccagtctctcaataataaaggctgagatttcttctgcatcgatattaagctcaccgttaaataccatcacgttcatataagaatgcacaatgcctcttgccataatggacagatctgcgacataccgctcgattccttttccataggacgacagcaaggcgttccggtacagcttatccgtctccatggttactttgtaaaagtattgcttgatttcttgattttccggaatgatattttcggtaagcaaaagtacgataaaatctttatgatcacgaaaatcctcaaattgagcgccaatttgttttttcaaaacttctttaggcggctttccagcaagatcttcttctatatttttcattttgttcatagacataccgatataatattcacaggcagataacagcagcgcttctttcgatttgaagtgcaaataaaaagcgcccttcgaaatgccgcattcactggcgatttcttggatcgtcgtagctgcgaatccttttttcgcaaataaacgaatgctggtttttatgattttctcttttttttcattcatgacgtgcttccccttaatccttgaaaaatttagtaaaattttctggtatatgagttgacgttgttgcgttataacgtttagtattatatagaatgaccagtcagtcaataaaaaatgtaatggaggatatgatgaaccacgttattaatttcgttctgaaaaacaaattcgccgtatggctgatgacgattattgtaacggcagccggcttgtatgcgggtatgaatatgaagcaagagtctattcctgacgtgaatatgccttacttgacgatcagcacgacatatccgggtgcgacaccaagccaagtggctgatgaagtgaccaaaccggttgaacaagccgtgcagaacttggacggtgtcagcgttgtgacgtcgacgtcctatgaaaacgcatcgtcggtcatgattgaatatgattatgagaaagatatggacaaagcgaaaacagaagcagctgaagcgttagaaaacgtcagcctgcctgatgacgcgaaggatccggagatttcacgctacagcttgaactcattcccgattctgacgctgagtgtgtccagtgataaagataacctgcaagagctgacgaaaaaagtggaggacagcctcgtttctaagcttgaaggcatagaaggagttgcgtccgtccaagtatcgggccagcaggtggaagaggttgaattctctttcaaagaagacaaactgaaggaatacggccttgatgaagatactgtgaagaaagtgattcaaggttcagatgtgacaactccgcttggattgtacacattcggaaatgaagaaaaatctgtcgtcgtcagcggcgatattgaaacaattaaagatttgaagaatatgagaatcccgacggcatcatcttcaggtgcaggcagcagtgcagcatctcaagcggcggcgcagagtgcacaggcagcccaaagcgcacaagcggcagcacaggcgcagcaaagcgcaagcacagcagtgccgacggtcaagctttctgacattgctacaattaaagatgtgaaaaaagctgaatccgtttcacgcacaaatggcaaagacagcatcggtatcaacatcgtcaaagcaaacgatgcgaatacggtagaggttgccgacaatgtcaaagctgagctgaagaagttcaaagaagaccataaaggcttcaattacagcgcaactctcgacatggcggagccgatcacacagtcagttgacacgatgttaagcaaagccatcttcggtgctatttttgcgattgtgattattctcttattcttaagagatatcaaatcaacattaatttcggtagtttcaattccattatcattgctgatcgcactccttgtgctgcagcagcttgatatcacattgaatattatgacgctcggcgcaatgaccgttgccatcggacgtgtagtcgatgactccatcgttgtcatcgagaacatttatcgccgaatgagactcaaagacgagccgctccgcggaaaagccttggtttgtgaagcgacgaaggaaatgtttaaaccgatcatgtcatcaacgattgtgacaattgcggtattcctgccgctcgcacttgtaggcggacaaatcggtgagttgtttattccgtttgccttaacgattgtttttgcgcttgccgcatccctggtgatttcaatcacgcttgtgccgatgctcgcacacagcctgttcaaaaaatcattaaccggtgcgcctattaaagcgaaagaacacaaacctggcagacttgcaaacatctataaaaaagtattgaactgggcgctgagccacaaatggatcacgtctatcatcgctgttctgatgctccttggaagcttgttccttgtaccgttaatcggtgccagctacctgccgtccgaggaagaaaaaacgatgcagctcacatacagcccagaaccgggtgaaacgaaaaaagaagccgaaaatgaagctgaaaaagcggaaaaaatcctgcttgaccgcaagcatgtcgatacggttcagtattcattaggctctggcagcccgcttgccggaggagattctaacggtgcgttattctatatcaaatatgaaagcgacacgcctgactttgataaagaaaaagataacgttctgaaggaaatccaaaagcaatctgaccgcggagaatggaagtcacaggacttcagctcttcaggcaataacaacgaattaacatactatgtgtatggcgattctgaaaacgatattaaagacacggtcaaagacattgaaaaaatcatgaaagatgaaaaggatctgaaaaacgtaaattcaggcctttccagcacatatgatgagtacacatttgtcgctgaccaagaaaaactaagcaaactcggtttaaccgcgtctcaaatttctcaggccttaatgtcacaaacatcgcaagaaccgctcacaactgtgaaaaaagacggcaaagagcttgatgtgaacattaagacagaaaaagacgagtataagagtgtgaaagatttagagaataaaaagatcacttccgcgactggccaggaagtcaaaatcggcgatgtggcaaaagtgaaagaaggatcaacatcagatactgtgtcaaaacgtgacggaaaagtctatgcggatgtcacaggtgaggttacatctgacaacgtcacagccgtatcagctgctatccagaagaaaatcgataagctagaccatcctgataacgtatcgattgacacaggcggcgtatcagcggatatcgctgattccttcacgaagctcggtttagcgatgctggcagcaatagcgatcgtttaccttgtgctcgtgattaccttcggcggagcactagcgccatttgcgattctgttctcattgccgttcacagtcatcggtgccctggtcggactttacgtatcaggtgaaacgatcagtctgaacgcaatgatcggtatgctcatgcttatcggtatcgttgtcacgaatgccattgtcttaattgaccgcgtgattcataaggaagcggaaggcctgtctacgagagaagcgctcctggaagccggctctacacgactccgtccgatcctgatgacagccattgcgacaatcggcgccttgattccattagcactcggcttcgaaggcggaagccaggtcatttcaaaaggactcggcgtcacggttatcggcggtttgatcagttcaacgcttctgacgctcttgatcgtgccaatcgtatatgaagtattggcgaagttccgcaagaaaaaaccgggaacggaagaagagtaaaaaaactaaaagcctcagctctgctgaggcttttgtgcgttttcacctgtaagattatgtacattttgttgcgatttttttaactcatagtataattaaaggttgttagtgtaaaaatggatcggatactcttaagtaggatgatgagataatgaaacgtgcacgcataatatacaatccgacttcaggacgggagatctttaaaaagcatcttgcccaggtcctgcaaaaatttgaacaagccggctatgaaacctccacccatgcgacgacatgcgcaggagacgctacacacgctgccaaggaagcggcattgcgtgagtttgacctaatcattgcggcaggcggagacggaacgatcaacgaggtcgtcaacgggcttgcgcctttagacaaccgtccgacactcggtgtgattcctgtcggcacaacgaacgacttcgccagagcgctcggaatcccacgcgaggatattttaaaagcggcagatacggtcattaacggcgtcgcccgcccgattgatatcggacaggtcaacggccagtattttatcaatatcgccggaggaggccgtctgacagagctgacgtacgacgtgccaagcaaactcaaaacaatgctaggccagctagcttattatttaaagggaatggaaatgctgccttcacttcgtccgacagaagtcgagattgaatatgacggcaagctgtttcaaggtgaaatcatgctgtttttggtcacgctgacaaattcggtcggcgggttcgaaaagctcgcgccggattccagcctgaatgacggcatgtttgatttgatgatattaaagaaagcaaaccttgctgaatttatcagggtcgccacgatggcgcttcgcggggaacacatcaacgaccagcacattatttatacaaaagcgaaccgcgtgaaagtcaatgtatcagaaaagatgcagctgaacctggacggcgagtacggcggcatgctgccgggcgaattcgtgaatctgtatcgacatattcacgtcgtcatgccgaaggagaaagcggaacagctggatgactaaaacttggctttgtaagccaagctcagaatgttgacaaaatcctaaaacagttttcgttttaggattttgtcatcttttcagcgtgattgaaaacctttgaagtctaggaaggacgagcatttgagcggagcgaatgttgaattcgtgagcaccgaagcacaggactgacaacgaatgcgaaggtttgcctacacgctgaaacttggcttgaataggccaagtttttctttcgcttaaaactagaggtgattatagatgaaaatgaaacccccagtagaaaaaaacgaatactatgacgtgacatttgaggatttgacgcacgaaggagcgggcgtcgcaaaggttcagggattcccgatctttgtgccgaatgccctgcccgaggaaaaagcccaaatcaaagtgacacgcgtcaaaaaagggttcgccttcggccgtctgattgagctgaaggaagaaagcccgcatagaacggacgccccatgcccgatttacaaacaatgcggaggctgtcagcttcagcacatgacctacgaaggccagctcctgtttaaacagaaacaagtcaaagacgtattagaacgcatcggcaagctggacctttcaaacgtcaccgtgcacccgacactcggcatggaagacccttggaactacagaaacaaagcacaggtgccggtaggagaacgggaaggcggactcgtcgccggattttatcagcaaagaagccatgacatcatcgatatgagcgcctgcctgatccagcaatccaaaaacgacgaagccgtccaagccgtcaaagacatttgcgcaaactacggtgtcaaagcctacaacgaagaacgccacaaaggctggctccgccacatcatggtcagatacggcgttgttacgggcgaaatgatgatcgttttcatcacaagaacaaacgatttcccgcataaagcgaagatcatcgaagacatcacagcgcaattcccgcacgtcaaatccatcgtgcaaaacatcaacccaaacaaaacaaacgtcatttttggcaacgaaacaaacgtcatctggggcgaagaatacatctacgacctcatcggagacgtcaaattcgccatttccgccagatcgttctatcaggtcaacccggagcaaacaaaggtgctctacgacaaagcgcttgaatatgcggagcttcaaggtgaagaaaccgtcatcgacgcctactgcggaatcggaacgatttctctcttcttggcgaagcaagcgaaaaaagtgtacggagtagagattgtgccggaagcgattgaagacgccaaacgaaatgccgagctcaacggcatcacaaacgcagagttcgcggtcggagaagcggaaaccgtgattccaaagtggtatgaagaaggcatcacggccgatacgctagtcgtagacccgccaagaaaaggttgcgacgaagccctcctgcggacgattgtggagatgaaaccgaagcgagtggtgtatgtgtcctgtaatcctggcacgcttgcgagagacctgcgggcgcttgaggatggcgggtatgcgacactcgaagtgcagcctgttgatatgtttccgcatacgaatcatgtggagtgctgttcactgctagtgagaaaagattaaacgagatgtcacagtgtcagaacccttccaacatagtggaagggttctatgtttgtgtagggaattataatgtaaatgagttaggagtggtacacatgggcagcggtttatatggacacagaaatattgaagatgagcgattaaaggaatggataaaaacgtggaaagcggagaattacattcatttttttagtaattattacggagtcggaatgaacgctgagtttaaagactctttggctaagcaagttgaactagtgatacaagagtcttcaagtatcactgtttcaaaggatagatacttgttcgatgaagtcatgaaatatatgactcctgaaatgttttattgctattttagatatgacagttcaactgcttattgtggtaattattatgaagtgttgattgaatttgctgatgaattaactaagaaaaagttaattaagggctatgactatgtacaaacaggcggaataatattagaaaagaatggtgaagtgataggacatattggtcaaatgagtgaccttttttggcacacgttttatgaccagtatattgtagaggattatggtgcaatagagcatgcgagaaacaatggcaaggatattaccctacaaatttggaatgacaaagtttttgaaaatacagagcagttttacaaattcattgaacagattttgtttgaatgtaatgttaatctaggctttggtttcaagatgtcaagatttgaaaatgaaagtaaattaaaagggcatacgtctaatactaaactatgcttaagtaatattgaattagaggaaacccccctaagatattttaactttgctaactatactaagataccacgacataaatacttagcttattatcaggttattgaatttttctttacaagagccgtcaggaaagcgaggtttcctcaaccaaacgaactcttaatagtaaaatacatagcaactaattcaataactgaattagaagtagttacatggcttgacgacattaagagcaggggtaagcactattcaaaaccttcggagaaataccctgcactttttcctttggaagctacagaaattgttgagtcagtagcaaaacggatttatttaataaggtgttcgttggttcattcaaaagaagcacctaatgatgttaatttcatacctaatcttaatgatgaaataatagataaggaaatatcacttatcaagtatgttgcagagaaagtattgtataaatggagtaatgctcccgaatagtcgagggtatgattatggcaaatcatttttaaacaaaaagaaagtccatgtatgtcgtaacaatagagacaatgtaaagttatggatgtccctatttctactggtaactgacgcaattctccgatgtggtattctcgtttaattcttgaggcaatgatagaagtttatcaatcttggtctcagcagatgaaaagattaaatgagccattttacctgaaaatttggctctataatccgaattttattaattcacaataggttgtcgcttatcgtgtgtgcttaaattattacggcaatacatataatagtttaaatttttatattagatgggtttataaaaaaatagcccagcagagagagctgagctatttttaaatttatagaccgaagtagtttattacaaattctttatcatcctcatcttcaggcaaaataccaaggtttttatattcccatattgcgattctttcatatccatctaattctgatgctaaaatatcatcataattataatctaattggaattctccgctacgatccaatgttagtgtaaggttcgtccaaacatcatcgttattatttctgtgttcagttcttaattcttcaaaaagttctcttagttctcttaacaacgtcttgaaaatatccttgcttacgttgtaatggctaggtatatcttgtgaataaataatttgattattttctagtgttctgaagtgaaaaagaaccattgtggaatcatctaatacttctgtataaagataaatttttgtccattcacaaggtatgatgtcatttaatttctgactaataagctgatacaaatcttgcatttttttagtttccaatcttttcaccttcaatcgtcgagaaatcttagttatcaaaaatagcccagcagagaagggctgagccatttttttgatttatagaccgaagtagtttattacaaattctttatcgtcctcatctttaggcaatatccctaaattttgatatttccaaacatctcgtctttgaaggtcatcaagttcagaggataaaacatcctcataattataatcaattgaaaactttccgatgttttctaattttaaagtgagattagtccaaatatcttggttgtctagtttaaattcttcttttagttcttcaaatagctcttgaagttcaattagcagttgatcgtaactctcttcgctcacatcaaagagttcaggtatataatgagaaaataaataatcactgttattatttggtgttgtaaaataaaagtatatatccgctgagtcatcaagtatttcagcatatacaacgatcttttcccattgagatggaatcatttcatttagatgttcagcaatcttttgatatagttcacccatttttttcattgttcatttagatattgttcaaggaactttctgctgctctcgcttattggtgtaattcccaagtgcttatattcccaaattacttgtcgctcagtatcagtatattttgaagcgagtacatcttcataatcataatcaattgagaattcaccgtttctatctaaatttagtgtgaggttagtccatatatctgaggattgctttttaaattcatcccttaattcatcaaataaatcttgaaggtctagcagcatatttttgtaaattcgattacttacttgaaaatgttctggaatatcgtgtgaataaatatattcttcgtcttcatgtgtgttaaagaaaaaataaacttctctggagtcatctaaaatttcggcgtatagagtaaccctcatccattcggagggaatcatatcatttattttttcagcaatcttttgatatagttgttccatttttgtagtttccattttcatcagcctccaatttggtttctaattgttatgctctttgttctttcttctccaattttatatgttatatcaaataaagtgggtcttaacgaatcgccctcatacacattttcaattgtgaccgtaaccttttttggaggttcttctttaagcgcttgcgaccatgcctgttctaacttataccatttcccaccgctcctattaatctgagaattcatcggcacgatattatcaaactggcctgagcctttgaattgggtggcgattaaatggcctccgtcatcgtcaggctttcggtcttggggctttccagcattcgtctgtgcatattggtttcgttttgcttctcccagctgcaagtctgctttgacacttgtaattctaccatagttgtcagtcgtgtacgtgtagccttcttttgttttgtagatgacattcggcttcagtactttctttctgctccatcttgcgaaatgctcgccgtatttgacggttaccggcggtacatgtggcgctggagttcgtcttccgcttgatgaggttccgtacggtttcggcaggatgaccttggcgaatttctggagtccctctttaagtgtgaccccgttgactgcgttgtaaggaatgcctgccggcactaaatcgtgacggggatgataggggagaatatccgcaagtgtgagatctccgatttgatttaatttggttttgacgtgtttttttgatacttctatgcctttgtttactttttgtttgatgtgatcaatggtttgttttgagaccgtgatggctttttgagcttttgctgatttgcttgctgctgttttgactttggccgtcactttggcggctgtgccagtttttgagacggctcctacgccttttgtgccgacaattgatgtgacaacagtgccaaccgcatatgacacccatcttgctcttgagtaggtgtcaccattcaccatgtctttttgatacgattcttcgattgccgctgaaatggcttcatacgttttgatcgggtgagccatcgctccggtaatcgcttcaacggttccgctcggatctgtgaccatatcccatagtcctacgaccgcgtctttcccggaatcataaaggccgacggcgacccctttgaagcctgcttcaagctcacgcgtgttttcaatctgtgtgaggtatctctgttgttcagctgtcagattttcatagccgatcgcttttgccatttcgtagaattcatcggcatccgcataatcatagtttttcagtctttctttcagtttttcaatctcgcgttccttcgcttcctctttcttaatcttcaagtaagcctcagtccgcttttcaatgtcgccttttttcttatgtatgtcgctctcacggtaagccttggcgttgtagtggatgggtgtggcgtttttgcctttgcctgttgcttcttggagcttttggaagtcggacttgatgaattgttcgtttggttctgacagggcgtattctgtcttcaggtcttcgtccaaggcgtccaatttttccagtgtttttttgcgtttgtcgttggcatcggccagctcgtctttgaaggtttctgttgaaaacaggtcgagcgggaggatgtcgtcgatatcgttcaggatgtctttcatcgcttttttctgttcggacatgatggattttgattttttattggcatttgccagttcgtgctccaggaaggattcttcgatgtatgcgtcagagagggctttgtcctccgcggctccggcgatgctattgaaaaatgcgattttcatgtcgatgtagtcgatccattggtcggtgacgccgacgtggtcgtgatagaaggctttgatgttgctggcgccttttcctgaaaattcgctgtcactgagatcagcgacactttttaacgcttttctcaagttgaccatttgcgttcttagttctttgtactcttttgcacggtctgtcgcttccgaaagcagtgttttcgcttcaaatactttcatgaccatttcccttcttttgttcactcaatatcaaaattttaccacggggcgggatgagggtgggggtgagaacgtgttttggtggaaaaatgagtcatttggcatgtgtctaagtgcatggttttgataagatgatgatagatcaataaaaaggggaagagctcatttggataaagacttcttaatcataaagatcaaggatattcaaaaaggtgacacgctaacgaaccgcgcttgcgggaactgggatatgaaattgtccagagcaaaggaatgtaaacgggcaattgttgttcggagcggtgtgattttaaatgtttacaagatcgttgacgcttgggaatctgatgaaccagccaaaatcactaaaacgaacaatagagtccggtttcaattggcagagtgccgagactattcttatttgattggcggtacgctgaaaacaaaaacgcaaaatccggtttcgagtctatccttagaaaccttaatggaactagtaaaataaaaggggtccagcatgtatctctataaagtaaacaatcaaaatcaaatcgaagatattcgcgagaaaccgtttaaaaaagaaaaagagattcaggatttatgtgaagccaatcttcagcaaatgttggggctagggtttgtgaaatctgaattcagaatcagtaatttccgcattgatacgttagcgtttgatgctgagacgaaatcttttgtgattatcgagtataaaaatacgaaaaacttcagtgttgttgatcagggctacgcctacttagcggcaatgctcaatcataaagcagatttcattcttgagtacaatgaaaatcatgatcttccgttaaagcgggatgatgtagactggtcgcagtcgaaggtcatttttatctcacctgtatttacagtgtatcaaaagcaatcgatccattttaaagatctgccaattgaattgtgggagattaaaaggtacgaaaatgatctgatccagttgaatcaaatgaaggctgatggcgtctccgagtcgattaagaccatttcgcagcaaagtgagaccattcaagaggtcagcaaagaaattaaagtgttttctgaagaggatcatcttgcagataaaccgtttgacatcatagagctttatcagcagctaaaggaattcatttttaatttggacgatcatatttcaatcaaaccgacaaagctttatattgcgtttacatcaaataagcgaaatttcactgacattcttcttttaaaaagcggacttaagctgtgggtgaatatgaaaaagggagaattgcatgatcccgaggagagaatgcgcgatgtctctgagaccggccactggggaaatggcgactatgagattttcataaaagatgaagaaaacattgaatatattatggggttgatcaaacaatcctatgagaaaaataagtgagaacttccattgagaagttcttttttattgtggcatagctaaagaagaattcatttcagtctctttcttcctatgtgaaaatcaaatgtacaaaccgacaaaagacctataaaataagaaagctaccatgagagaacagaagggtgagaagagacaatgagttataaattgggtgcgctgcttttatctattttattcctattatcggcgtgttctgatagcggagcttctgataaggatcaggaaaagcaagccgtgaagaaagcgagcgttgcgaagctgacggagcaggaagtaaaatcagctttgaaaaacgatattgatgcgatcttcaacgcatttgataaagcgggaacagaaaacggctggagcacagcgaataaggctgatttcagcaagttgcggcctagtgtcctgccttatgcaacggagacgtttgcagatcagactttaaagaatttggctggagagtactattgtgagtgtgatgctccttttcaaccgggcactgatttcgatgtgcgttttacatatgaacagaacaagaataagatagaggcttcatcaatagatccggcaacagaattaaacaacatgggcacgttatggacgtttgaattggtgaaggaagatggcgattggaagatcaacaaatgggacagtaagtcgcttcaaggggatgatatcaagctgacaaaagaagaagcgaaaacgattctgtctagaaacggtgaaacggcggaatttgtgaagtcctatgaatcgaaggctgctggcggaacagcttatcttttcaatgtgaaaagttcaaatggggaaagaaaggcagcgatcagctcaaaggataccagtctggtaagtgataatgaaaacgagactgaggccccggagcaagagacagctcagaagactgcggaaaccgcatcgcctgatacagcggatacacagagcagtgagcagacaacgggaagcacaaaagcagattatgttgccaaattgtcagcgacagaacagaaagaaaagcacaatgactatcaaagtgattatcagatgattgaggattacggttacaactatcaaatgtgggacggattgctgaacgagatatacagcgtgctgcaaaaacagctttctgcttcagatatggcggcattaaaagtgaaacaacgccaatggatgaaggatagggatgctgcggcccagaaacgatatgatgaggagggcggcggttcattatcccgagtcgtccaaacggaagagcttgccaaacagacgaaagagcgctgttacgagctcgtgaatacgtatatgaaatagaatgacaaagacccttgcgtaaagggtcttttttgcgtagaaaaacaaattgacaggatgaaaaagcaatttcttccttctgtattgttttcaaaatttgggattgatagaatatgacatatctcatagagaaggagggaagccgttgagtcaagccataccgtcttcgcgtgtcggtgttaagattaatgaatggtacaagatgattcgccagttcagtgttccggatgctgaggttctgaaagcggaggtggagcaggacattcagaggatggaagaggatcaggatttgctgatctattattctctgatgtgtttccggcaccagctgatgctggattatttggagccgggacaaccttacgggaatcgccctacagtgacagagcttcttgaatcgattgagacccctcagaaaaaactcacaggccttttgaaatactactctttgtttttccgcggcatgtatgaatttgatcaaaaagaatatgtggaagcgatcgggtattatcgcgaggcggagaaagaactgccgtttgtgtcagatgaaattgagaaagcggaattccattttaaagtggccgaagcgtattatcacatgaagcaaacccatgtgtcgatgcatcatattcttcaagccttagacatttatcaaaaaaatcccctatacagcattagaacgatacaaagcttgtttgtgatcgccggcaactatgatgatttcaaacattatgataaagcgctcccgcatttagaggcggcgctggaattggcaatggacattcaaaatgacaggtttatcgccatttctctattgaacatcgcgaacagctatgacagatcaggagatgatcagatggctgtagaacatttccaaaaagcggcgaaagtaagcagagagaaagtgcctgatctgcttccgaaagtcttgtttggattaagctggacattatgtaaagcgggccaaacacagaaggcgtttcagttcatagaggaaggattagaccatatcacagcacgttctcacaaattttataaagaattgtttctgttcttgcaggccgtgtacaaggagactgttgacgaacgaaaaattcatgatcttataagctatttcgaaaaaaagaacctgcacgcttacattgaagcatgtgcccggagtgctgccgctgtttttgaaagcagctgtcactttgaacaagccgctgcgttttatcggaaagtgctgaaagcccaagaagatattctaaaaggagagtgtttatatgcctattaagaaaaaagtgatgatgtgtctggctattactctagttttgggaagcatgtcgtttccaaccctgacaaactccggcggatttaaggaatcaacagatcgaaatacgacgtatatcgatcattccccttacaaacttagtgatcagaagaaagcccttagctagggctttttattgctttacggaagacgttccatttttcacatcgcggcattccttctatttctaacgcaagacactcgaaacaaccaaaccatttgaggtataatggataaagtgaataacagtatttagattgatatatatgaaagagagtggaacatcatgggccgtaagtggaacaatattaaagagaagaaggcgtctaaggacgcgaatacgagtcggatttatgcgaagtttggccgtgagatttatgtggcggcgaagcagggcgagcctgatccggaatccaaccaggcgctgaaggttgtgcttgagcgtgcgaagacttacagcgtgccgaaaaacatcattgaacgtgcgatcgagaaggcgaagggcggagcggaagagaattacgatgagcttcgttatgagggcttcgggccgaacggatcaatgattatcgttgatgcgctgacgaataatgtaaaccgtacggcgccggaagtgcgtgcggcgttcgggaaaaacggcggaaacatgggtgtgagcggatctgttgcttacatgtttgacgcgacggctgtaatcggtgtggaaggcaaaactgctgacgaagcgcttgaaatcctgatggaagcggatgttgatgtacgtgacattttagaagaggatgacagcgtgatcgtatatgctgagcctgatcaattccatgcggtgcaagaggcgtttaaaaacgcgggtgtcgaggaatttacagtagcggagctgacaatgcttgcgcaaagtgaagtaacgcttccggatgatgcaaaggaacagtttgaaaaattgattgatgcattagaagatttggaagatgttcaacaggtatatcataacgttgatttaggtgagtaaggagtgagcaggctgttatggcctgctttttttgtcctggaaattgttttagctgtatgtaggcggccgcctatacgatctataagatattctcatactctggactgtaacctatgtgaaggagagagtgaatatgactgatacaagacatatgtatggcggacctggttttggtcattatcagggctttggtattggccacccgggctatggcatgcaaagcacaggccacccgggctttggcatgtatggaggctacccagatcacggcatacatggaggtgtcggcggctatccgggatatggaacgtacggaggatacggaggacccggcggttacccaagcggcggctatggaggctctccgggaactgtaaattatccgaacatgcaccatgaaaatgatggccatcaccactattatcaccatcatcatgatggaaaagataatcttcatcaccatcatcaccatgttggaaaggataattatcaccaccatcatgatggtcattatggccaccatcaccaccatatgggccactggggaaaagacggttataaataaagaagatgatggtataaagaggacactcttgcagatcaagagtgttttttatcttttttcttgactgttcagtctggaaactggtaacatttgtttcaggaggtgatcgttttttggggaggaataaagaatttgatacggcacttgttcttcacagggcgatagaggtttttggagagtatggctacgaaggaacgtctcttcagggtctgctctctcatttaggcattgcgcgccagagcttgtatgatacgtatggcacgaagcgtgatttgtttttgtccgcggtgaaatcgtatcttgaagggaaaaacgctgcagttatggaaaggcttgaagcgccaggatctgtaaaggaagccattcgtgatatttttcaggagggtgtcaatgccctgagggatccggagcgggcgaaggcgtgctacattatgaacagtgcgattgaacagatcccgcatgaccctgagcttgcccggtattttgacagacaatccaagcagcttgaggacgctttttatcaggcgcttttaagggcgaaggatcaaggagaattgaatggcgaagatcatgatatatctgcgctcgcccggtacctgaatcagagcaggctgtcactgacatttattgcaaaagtgacggcagatatggatcgtcttcaggaccatgttgacgtgagtttatcagtgcttgattaacatgtggtaaagaattctttgcccatgtgtgtattttttggactgaatggtctgaaaataaaaaaagaggtgatgatgaatgttgatgaatgaatttgaaaaagcatgtgaaacattgagaaagtttatggcttatatgcttgagaaggacatgaagagctggatggagctttgggatgagaatgctgtatttgagtttccttatgcgccggagggatcaccaaaaagaatagaaggaaaagcggccatttacaactatattaaggattatcctaagcagatccatctttcttcatttaccactccgacagtgtaccgttcagcagactcgaatacggtgattgcggagtttcaatgtgacggccatgtgattgagactggactgccttatcgccaaagctatatcagtgtcatcgaaatgagagacggccgcattgtgcgttatagggattattggaatccgcttgttgtaaaagaggcctttggaggatcatttttgcaaacagaggagagtgggaaatgatgaaacagaatccgattttaatcacgggcgggactggcacagtcggcagccgaatcgccagccgtttaataaagctgggatacagagtgcgtattgcaagccgaaaaaagggcgcgcttgcaagtgcggagtatgtgtattttgattggaaggatgcctccagttttacgcctgctctagaacaggtaaaagacatctatcttgttgctccggtcggtgtacttgatccggctccctatgtgcttccctttttaaaggaagcaaagcgtctcggcgcaaagcgggtagtgatgcaaagtgcgtctgttgtctccgagaacggtcccgtgtttggcgcgcttcaccaggcagtgcgcgagtttccagaatggacggtgctgcggccctcatactttatgcaaaatttcatcaatgtccagcatcgcatgtctattcaaacggaggggcgcatcacaacggcttcgggtgaaggaaaacttgggtttattgacgctgatgacatcgcagaaacagccgtcagggctttgattgatgatgttcctcatcaaacacatcatattctgacaggtcccgaggcgctgagctatgccgaagcggcggagatcattggagctgcggcgggacgccgggtggagcatgtcagcatttctcgttccgagctgcaacataaaatggaggcaggaggtttgcccgcggattatgcccattttatggcgaagcttgatgaggcaatcagccatggtgcggaacatcgggtaacggatacagtgaagcgtgtgacgggaaaagaacctcgttcgctgtcagagtttgcggctgctcatgctgcatattggaaacactgacctcatttcggactgaatagtctagaaagaccttcggcgcttccgaaggtcttcttattgaaaaagctaagtcgtgttttagtcataatcatgcctcctgcctcataccttattaaggtcattgtttttgagaaaggaggagccggaatgaaggatatgcagccgtttacgcctgtcaaatcatatacgccctttcacagccgttttgatccctgtccgcccatagggaagaaatattacagaacgccccctaacctttatatgacctttcagcctgagcacatggagcagttttcgccgatggaggctttgaggaaaggcaccctttggaaggatctctatgatttttatgaaaacccttatcgagggggagacgcacatggcaaaaaaggttgacgccgaatattatcgtcagcttgagcaaatacaggctgctgattttgtgcttgttgagctgagtctttatttaaatacacatcctcatgatgaagatgcgctgaagcaattcaatcaatattccggctattcaaggcacttaaaaagacagttcgaatcctcttacggaccgcttctgcagttcggcaacagccccgcgggcaaggattgggattggggaaaagggccatggccgtggcaagtataaggaggaatgcctgaatgtgggtgtatgaaaagaagctgcaataccctgtcaaggtcagtacgtgcaacccgacgctggcgaagtatttgattgagcagtatggcggagcggacggcgagctggccgcagctctccggtatttgaaccagcgttatacgattcctgataaggtcatcggccttttaacagatatcggcacggaggagtttgcccatttggaaatgattgcgaccatggtctataagttgacgaaagacgccacaccggagcagctgcgtgaagctgggcttggcgatcattacgtcaatcacgacagcgcgcttttttatcataatgcggcgggcgtgccgtttaccgcgagctatatccaagcgaagggcgatccgattgccgatttatacgaagatattgccgcagaagaaaaggcgcgggcgacgtatcaatggctgattgatatttcggatgatcctgatttaaacgactccctgcgttttttgcgagagcgtgaaatcgtacactctatgcgcttcagagaagcggttgaaattttaaaagaagaacgggataaaaagaagattttctaataggcagattggcctctctttcatacacccttttacatacagagaaaatggtctgtttttgcagtttggtctgcattataatcaaggtgtgtgtgcaagcttactttttgattgggaggcctttatgtcagcttttaagattgagaacgaaacgattgcagatggattttacgcgtgtccggccgtctatgaggatgcagaatcgattaccgggttgctcgtccgaacagctgaatggctccgggatcggggttctaaccaatggagcggacttctgaaagggcaagatatacatgatattacggggtcaattgaaaagggacatgtgtttgtgtttaaaaaagatgatgagcttgcggctgtcgtgatgctgctgcctgaaccgagcgagtgggaccggacgctttggggagacgatgggcatgaggagtccatttatttgcatcgcctcgcagtaagccgccggtttgcgggacaggggctaggagcccgcgtccttcagtgggcggagacgggcatacactttccggaaaaaacgcggatccggcttgactgtgtcgctgatagcgacgccctgcattccttttatcggcgtatgggatatgaattcatgggtgctgatgcgtccggatatcatttgtttgagaaagagattacggcagaataagcgtcctttgcagggggcttttttgtctttttctaaaagggagggcaggcgatgtgtggccaatattatttgtgacagggattgtgacggcttgtctgtttgctggcgtatccgttttgatgcggatgagatttcctgacaaaagtcggccggaatggatgttggccgggctgatcgtccttggtgtgtttgcgatctggtacagcctcgtgtatgtacgcggctgggaaggggctgcgctcggaatgcttggattcaatgtcattttcggagccattgccggatatttgatcgataaggccatccggcgttacaggaaaagataaggctgctgccgtctctcatcatgtcgaaattttcacagaacggcaggaattttctttcgaaaggagaaatacatattactttaaaatgaaagcgttttccgaagcgggaaggtgatgttgatgatacacagtgtgacaaatgggctgaatcgtttttgtacgtgggtgatgagactggcctatttgaatgtgctttggattttgttttctcttgcaggcctggttgtatttgggctgatgcccgctactgccgcgatgtttacagtggcgagagaatgggcgaaggggaatacagatgccccggtgttttctgtcttttttcggacgtttaaaaaggaatggcgggcatcacagatcctcgggcttatcgttgtgacggctgccctgtttctgtttgcggatatgcggatagcggctcagatggaccagcctgtgctcgtcaatgtattcctgagcattagtttgattttcgcgtttgttgtgctgtatgtgttcccggtattttctcattttgacgtaaaaatcagagaggtgctgagcatcagctttttcattgccttcagccgtccggcggtgacgcttttgatggcggcgggcgctgtcggtgtgctttgtctcgttctgtttcatgtcacgtttctattgtttttcagcgggagtttactcagcctgatcttaacgaagctgtcctttaaagcgtttcggtcaatggatcagcggcaggagaaagaaaaggcggcatgaagaaaagagttgctggctggtacaggcggatgaagattaaggataagctgtttgtgtttctatcgttgattatggccgtatcctttctgtttgtatacagcggggtccagtatgcctttcatgtgtatgatgagcagatttaccgcaagtcctcggaggtgcttcggatgtcttctgaaaggatcgaagacgagctgaagaagatagaggatgtgtcatatgaaatcattacagacgaacagattcagcgcatcctgagcatgcaaaatcgggatgatacgtatgatcaatatcaaatgaagcaggagctgtgggatcagcttgccggatatgccagcgatgaaaagtacatcgattccattcatttgattgatgcccgcggctcagagtattcagccggaagcagttcttcagatcttttgcagcaggagcaggaagaggtatttaagcgagtgaaagcgaaaaatggaagaaatctttggatgacgctcggcgggtcagatcctgtcctgatttcagcacggcagatcaggtcctatcaccagctgagtctgaacggcttgggcatggtgctgatccaagtcaatgtaaaacagatgattcgtgatgtgccgaaggattggggcgattcagtcggagacattatgattgctgaccaaggcgggaatttggtgtatacggcacatgcatcagcgcatgttcctgaggcagcaaaagagacgctgaagcaccccggttatgacttgataaaaaagaatggcaaacgttactttatttcttatcttcaatcatcctaccaaaattggagctactataacgttatcccctttgatcagatgttcgcgaaaatttcctttatgaaaacagtgatcggcacatgctttctcctctttttctgtgtggttttgcttttcggaaggaaaatcgccaacagcatcacggagccgattgaacagcttgtgaccgcgatgaaatcggtacagcacggcggtattgaagcaggtgtgtcgctttctctgccggaacatacacaggatgaggccggcatgctgaaccgccattttactgtcatgatgaaacggattaatgagctgatggaagaaaatgtggaaaaacagctcattattaaagaaaccgaattgaaagcactgcaagcccagatcaatccgcattttttatataacacgctcgagtccatcaattggctggctaaggcgaatcagcaaaagcaaatctcaaaaatggtggaatcgctcggttttcttctgcgaaacagcatacatatgaaaaaggatatcgtgaccattcaggaggaggcggacattgtacgtcactatatgaccattcagcgatttcgatttgaagagcgcctgaatttcacgttggatattgacgatgaggtgaagcattgcctcattccgaaactgacgctccagccgcttgcggaaaatgcgattcaatacgcgcttgaaccctttacaaggccatgcgccatccggattcaggcgaaaaaggcaaaggaacgtgtctgtattacggtcgaagataacggccctggcatggatggacggattcttgaatcaacgggcggaagaggaatcggactttggaatattcgcgagcgcattagcctgacattcggagagccatacggcttgcggattcatagtgagcatgaaaaggggacgaggattgtgatcacaataccgtgccgaaatgaggtggtgtgatgtataaaatactgctggctgatgatgagaggattatccttgatggaatggcaggaatcattgagtgggagtcgcttggcgcctcattgatcggtaaagtgcagaacggacatgaagcatatgtaaagattgtacataagcagccgcatatcgtcatcacagacgtcaaaatgcccggtatggacgggcttgagctgatcaaaaaggtgtcagccatcagtccgtcggtgcagtttatcgtcctgtccgggtttggagagtttgagtacgcaaaggaagccatgaaatatggggtgaagcattatttgctgaaaccctgcaatgaacagcagattatcagctcgctggaggaaatcattgctgagctgaagcggcaagatgtgcacaaaaagaaaacagcccatctgaaacacgagctggaccatatccgttcctttgcagccgatcaatacttggaaggcttgatcgcaggtgtagcccagttgtctccgccgccttcacttgccggaaaaaagatccgcctcttgatcttaaaaggggaacaatctattgatgccgcagccagagaggcactcgggtcggtactgacagcggtttgcagcagcggagaatggacagtgctcgccgtagaggagaacgccgctgaaaaggcggcggaggtttttgcggaccgcaagatggccatcagtcaggcgggagaactccggcacgcggggcagctgtttcgtgacacagctgaagcgtctggtgacctgcatgggagcgcagtgatttcaaaaatgatcaggctcattgccgacgaactcggaaacccgaatctatccttgaagtgggcagcgaaggatatgctgtttatgaatcctgattatctcgggaaattatttaagcaggaaacaggcgagaaattttcccaatatgttacacgagtgcgtcttgaacatgcgatgaaacagatgaaaatgaggcgggatgcgagtgtatcagaaattgctgaagaaatcgggtttggcgataatccgaagtatttcagtcttgtttttaaaaaatataccggtctgacaccgtcagaattcagaagaaaacagggaggcgcttccgcaggatagccatctctgtttttttgactttcgccactgttttttgagtgtttcgccctatccgaacgctttaaaataaaatgtaagcacttacattaaaggggggattggtttgaagaagatttgttacgtgctgttatcccttgtctgcgtctttttgttcagcggatgttcagcaggtgaagaggcctcgggaaaaaaagaagacgttacactcagaatcgcgtggtggggcgggcagccaaggcatgattatacaacaaaggtaattgaactttacgagaaaaagaatcctcacgtccatattgaagcggaatttgcgaactgggatgactactggaaaaagcttgcgcccatgtctgccgccggccagcttcctgatgtcattcaaatggataccgcttacttagcccaatacggaaagaagaaccagctggaagatttaacgccgtatacaaaggatggaacgattgacgtcagttcaatcgacgagaatatgctgtcgggcggaaaaatcgacaataagctatatggatttacgctaggtgtcaacgtgctgtctgtgattgccaatgaagatttgctgaaaaaagccggtgtgtctatcaatcaggaaaactggacgtgggaggattacgagaagctggcgtatgatcttcaggaaaaagccggtgtctacggttccaacggaatgcatccgcctgatattttcttcccgtattatttgcgcacaaagggtgagcgcttttacaaagaagacggcactggcctcgcgtatcaagatgatcagctgtttgtcgattactttgaacggcagttgaggctggtgaaagcgaaaacgtccccaacacctgatgaaagcgcacagattaaagggatggaagacgattttatcgtcaaaggcaaatcagcgattacatggaactactccaatcaatatttgggctttgcccggctgacagactcgccgctgtctctctatctgccgccggagcaaatgaaggaaagggcgctgacattgaagccgagtatgctgttttccattccgaaaagctctgagcataaaaaagaggcagcgaaatttattaatttcttcgtgaataatgaggaagcgaaccagctgattaaaggcgagcgaggcgttccagtctccgacaaggtggcggatgcgattaaaccgaagctgaatgaggaagaagccaacatcgtggagtatgtagaaaccgcgtcaaaaaacatcagcaaagccgatccgccagagcctgtgggaagcgcggaggtcatcaagctgctgaaggatacgtcagatcagattctgtatcagaaggtatcgccggaaaaagccgccaaaacgttccggaaaaaggccaatgagatattagagaggaataattgacgggaaatggggctgacgcaatgaaaaaaagccggagtataagaaaagacaatctggcgggatatgcttttatttctccgtttatcatcgggttcctatgctttacggtgatcccgatgggggcgtccctgtttctgtccttcacgagctatgacttgtttacggcgccgaaatggatcgggctcgacaactttaaggaaatgtttacgggtgacgaaaagtattggcagtctctgaaggtgacgtttacgtatgtgcttgccggggttccgctccgcctcggcttcgcgctttttatcgctgtcattttaaacaatgcagcaaaaggaacggccatttacagaacgctcttttatctgccttcgatcatcggcggaagcgtcgccgtggcgattatgtggcgcaatatttttggcaatgacggggtcatcaatgcgctgctgttttttgtcgggattgaccaaaaaattctttggtaccagaatccgacaagtgcgctgtggacattgattctgctgtccgtctggcagttcgggtcgtcaatgctgatttttctggccgggctgaaaaacattccgtcttcgtatttggaagcggcaagtgtggatggggcaaatcgggtgcagcgtttcttcaagatcacccttccgatccttacaccgattattttctttaacctagtgatgcagacgatttctgcttttatgacatttacacctgcctatatcatttcgaagggcgagggcgggccgcttgacgggacacttctctattcgctctatttgttccagcgtgcgtttaactattttcaaatgggctacgcatcggcgatggcgtgggtcatgcttgtcattgtcgggctgattacgctcatattgtttaaaacatcgtcatattgggttcattacgagtcaaaggaggaatgacggatggagccggtcaacgagcctgtcagaaaagccccggtttttgaaagaaaaaaagccggtcgcgtcagtcccaaacgcatactgttccatgtttgtacggcaacgctggcggtgttactgctgtacccggtcatttggctgtttgtcagctcgtttaaagaaagcgccagtatttttacaacctcacattctctcattccagacccttttattctcagtaactatgctgaagggtggaagggcattgcgggacagccgtttctgacgtttattaaaaactcggcgattattgtcgggctgtcaacaatcggtgccgtcctgtcatcggctgtcattgcgtacggatttgcgcgtattccgtttaagggaaaaaaattttggtttgcgtgcatgatggggacgttaatgctgcctcatgaagtgttgatgattccgcagtatattatgtttgcgaaattagactggctgaattcctttaaaccaattgtcgttccgcaatttttcgggcatgcgttttttatctttctgatgatccagtttatccggacgattcccgaggagctggatgaagccgcgcgaatcgacggatgcggacgctttgcctgcttttggcggatcattctcccgctgattgctcccgcgcttgcgacgtctgcgattttctccttctattggaagtgggaggagctgattcagccgctcttgtatttgaataagccggagctttaccctgtttcacttgcgctgaagctttttctcgatacagagtcggcttcgaactggggcgcgatgtttgccatgtcggccgtctcgttattgcctgtgattcttgttttctttttgtttcagaaatatatcgttcagggcatcagtacgaccggattaaaataaaaaggagtgttgcagatggcacagcttatctttgatgatgaaaaggtgacgtccgtcattgaccggatcgtgaaacggacatttcagatggattttgcgtgggattggccgggcggcgtcgcgttttacggtgtggcggaggcctatgaagcgacggaaaacgaggaatatatcaatctgttaaaaacgtgggtggatgaacagctggaggatgggctgccgccgctttcgatcaacggagtttccatcgggcatacgcttttgttcctccacaaggtgacgggtgatgacgtgtatttggaaacagcggccgaaatggcggaatatgtgctgcataaggcgccgcgctttggcgaaggtatccttcagcatacggtgaatgcggcagaatatgtgtttcctgagcaggcatgggcggatacgctgatgatggctgggctgtttatgctgagaattgggcggatcatggagcgtgaggattattttgaagacggcctgcgccagtttcacggacatgaggatgtgcttcaggaccctgtcacgaatttgtactaccacgcctgggacaacaaagcgcaaaatcatctgtcggggatttattggggcagggcgaacggctgggcggcactcacgatggcaaaggcgctcccgctcattgaggtgacacatccttcctttatgatcatcgacggatcgctcagagaccagctgagcgcgcttgtccggcttcaggatgaatcagggctgtggcatacgattttggatgatcccgattcttatctggaggtttcggcatcagcgggtattgcttctgctctgatgtcgagcggaaagctgtatacaaaatatgtgcagaaatcgcttgccgccattttggatgcggtggaagaggacggacgggtcagcaaggtatcggcagggacagccgtcatgaaaaatgccgaaggatacaaacaggtgccttacaaacgaatacaaggatgggggcagggacttgcgctgacgtttcttgctgatgttttgaaaacgaaaaaacgcgtgtatcagtaaagacagcggcggggggaaagggatgaaaaaacagcctcaacagaaggaacgggtttctcgctggaagggaacgtatttcaaaagaaactttgtcttcattttgctgattgcctgtattcccggattgctgactggcggcgcaatctactttctttcgatcgacaaggtggagaaagagctgcagagatcgcatgaaacacaggtggcgcgtgaggtcagccgaatggatgagaagctgggagtgcttgaactggcactcacccatatggcctacgattcttcactgatgaatggattggccgagagggatttggagaaagactttacgttctcctatcaattaacgaaaaagctgtttcttttgcgggaccagcagccgctgatcgagcaggcttccatctttctgaacagcccccggccacttgtgctgagccctgaatacagcgctttgacagaacaggaggcgcttcgcaagtatcgctcgctgcttgcctcagaccgcagcatttattggaaacggtcgggaaaccaagcgatgctgatccagctcattccgggcgcggcggagaaaccgttcggcgcgatcatgctggcggttgatccgaaagaaatggaatcaatcctgcaaagcttgtccccctatcctgatggcagtgcgctgcttttagatcaaaatcaagaggtgctgtttcatgaaggggaaatagattttgaaaagactttacttcaagagataaaaaaacagcctgctgagaaaggtcattttcagatggaatgggaaggcaaggtgtattctgtctcctttggagaaatgaaccggatgcatcagcaatggacctttgtgtcagcggcgcctctttcagctattacagcgccgatggtgtttttatcaaaagtgatcatcgtgatgctggtcatttgcatcggtttggcggtatgcatgacatggtatgcatcaaaaaaaatctatcgtcccattcagcatttgcttggcttgtttaccggaggagagaagaaagtatggcaggcgtccgggcaggatgaattcaagtggattgaaaagagatggcaggatctatcccttgaaagccggaagctccaagagcagctcctgcggcagacgccccatatgaaaaagagttttttgcagcacctcttgcagggggatttttactatgacaacgaggacagtctcagatctcggatggaggaggccggctggaacatcggcgaaaacgtgtttcatgtgctggatcttcaattgacaggactccgctgtgaaaaaagcatcttctgttgcgatgatgaacagctcgctgtgtttacactgactaatatcgctggggaattggcggataaacgcgtttttcagctctccatacttgatatcggccggctttctatcaccgttcttgtgatgaaaacaaacagctctgatctgaaggcgtatataacggagctggcacgccaatttggggatgtaaccggactatgcctgacctcgacattgagcagcgagacggagcgtgtcacggaaattccttctttatttcagaatgtgaaaagcggcaaatcctgcaggcagtttgccaaccggaatcaggtcattgatttgcaggccgacttccctcaggatgagcagtttgctccttattacccttttgaactggaaaaacaaattgttcaggctatccggctggaaagaaaacaggaggccgaggaaatgattcgtgtatgcatggaggaactggcggaaaaggcggctatagacaggcatgtgcactccgccctgattcagctgttttcccgcattcaggaggatattttgcattccgggctcaatcccagcgaactgtttcagcaccggaatccgtttcttgatatttcagaattgcgcgaacctaacgaagcggcggcctggctgatggatgcagtggtgacgccttacctttccaagcttgagggcagaaaaaacagacagcaaaagcagctggcagaacgtgtgattgcgatgattcacgaacagtatatggcggacatttcattggaaagctgtgccgatgcgcttggcatgaattcatatacgttaagcaaggcatttaagcaagtgaccggcattaattttatcgattatgtgacccagatcagaatcgaaaaggcgaaagaactgctggtcaatacgaataaaaaaattcatgacgtgtcagaagaagtcggctaccgccacaattatttcaatcggatttttaaaaaacaggtcggcatgccgccgggtgtcttcaggcaaatgtatcaggaaacgccgtgaaaggagagaacatgtgatgaagaaaccgattcaagtatttttagcgggggattccactgtgagtgactgcccgcctcatgaagcgccgatggcggggtgggggcaggtattcgggcaattgttttctgaaggtgtgctggtccgcaatcatgccaaaggaggagcgagcaccaattcttttgtggaggaaggaaggcttcaagcaattgccgagcgcatcacacaaggcgattatttgttgattcaattcggccacaatgaccaaaaaccgcgggggacgaagccgtactccacatttcagcagtttcttaccttgtttgcagatacggcacgcgaaaagggcgcgcatcctgtgttcgtcacatcggtgcagcgccgccgctttgatgaaaacggacggatcgagcattccctcggtgagtatcccgatgcgatgaaagcactggcgaaggagctcgatgtacctgtgattgatctgcttgcgaaaacaagggtgctgtatgaagcatacgggccagaggagtcgaagcgattgttcgtttggtttcagccgaatgaacatccgaattacccggacggcattgaggacaatacgcatttttcggaagaaggtgcaatggaggttgcgaagcttgtggcagaaggcattgaagagctcggacttccgcttaagaaccaccttgtgagccgggagggaaaagaacatgtataaggaaggcgcttgcttgtaccgcaatctgctccggtctaaaagcgatgtgaaggactggcggatggagggagggggacagatctcatttgacgatcacagcttgcacctgtcacatgtccaggacgatgtgcactttgtcttttggtgtccggaaacctttccagacggcatcattgtgacatgggacttctctccgatcgagcagccgggattgtgtatgctgtttttttctgctgcgggaatgggaggcgaggatttgtttgatccaagtctccagaaaagaatgggaaaataccccgagtatcattcgggggacatcaacgcgctccacctgtcgtatttccgcagaaaatacgcggaggaaagagcgttccgcacctgcaatttaagaaaaagccgcggtttccacctcgctgcaatgggggccgatccgctgccttctccagacgacgctgattctccgtatcgtatgaagctgatcaaagacaaaggctatgtgcacttttcaatcaatggtctgcccattcttgagtggatggacgacggcagcacatatgggcctgtgttaacaaaaggaaaaatcgggttccggcagatggcccccatgaaagcagcttacagggattttgccgtacatcaagcggtgagaagatgaagacgactgtaacggatgcgctttatgcaggctgcgaagcggtggtgaaaatagcatggctcaacgggctgtggctgttgtttacacttttgggcggcgttcttttcggatgggcgccgagcacagctgcgatgtgtgccattataaggaaatggctgatggggcaaaaggatgtcccgatattttcgttatttctcgatacctataaaaaagagtttctcaaggttaatgcgatcggattggcgttttcggctcttttgctcatattgtctgccaactatcattatttttctgccagtacggattggctgtcctttgcagtaacaagctgcacgctgcttgcagggcttttgtatatcatcgcgctgatgtatgtgtttcccctttatgtgcattaccagctcccgcttcgcaaatatattccgcaggcactgctgtttggcgccatgagaccgctgacaaccggctgtatgctgatcgggtgcggatttgtcctttatttgctttatacgcttcctggcctgatcccattttacggcccgtgtttatttgggcttgtgttgatgttttttgctcttaggggatttcaaaagacggaggcccagcaccatcaagccgggtaacaaaaaagtgacaaatacgcaaaaaagtgcagtgtccgaaataggcagatgcaaaaaagtgaaattgaagacagctcacacagcgcataaaattcaatttaagtaagcgcttacagataaatgagaaggagctgtctgatgattacacgaaggaaacgcatgtttaccgctgttacgttgctggtcttgttggtgatgggaacctctgtatgtcctgtgaaagctgaaggggcagcgcggcagatggaagcgctgaaccgggggcttgtagcggtcaagacggacgggggcatttttgtcagctggcggtttcttggaaccgaaaacgcatctgttttgttcaatgtgtacagagacgggcaaaaactgaatgctgcgcctgtcaaaaccacgaactatgtggataaaaacggatcggcgggctcaacgtatacggttcgtgctgttgtaaacggtaccgaacagccggcttctgaaaaagcctccgtatgggcgcagccgtatcattccgtcccgctggataaaccggctggcggcacgacgccaaagggtgaaggttacacgtacagcgctaatgacgcaagtgttggcgatgtggatggtgacgggcaatacgagctgatcctaaaatgggacccgtctaactcaaaagacaattcacaggatggctatacgggtgacgtgctggttgacgcgtataaactggacggcacaaagttatggcggatcaatctcggcaaaaacatcagagcgggcgcgcactacacccagtttatggtgtatgaccttgatggtgacggaaaagcggaagtggcaatgaaaacggcagacgggacaaaagacggcacgggcaaagtaattggaaatgccaatgctgattacagagatgaacaggggcgtgtgctttcaggcccagaatatctcactgtgtttcaaggttcaaccgggaaagagcttgtcaccgcaaattttgaaccggcgcgcggcaatgtgtcggattggggagacagctacggcaaccgtgttgaccgttttctcgccggcattgcctaccttgatggacagcggccgagcctgatcatgaccagagggtattacgctaaaaccatgctagttgcctataacttcagggatggaaagctgtcaaagctttggacgctggactcctcaaagtcaggaaatgaagcgtttgccggacaggggaatcacaacctgagcatcgcggacgttgacggggatggaaaagatgagattattttcggctcaatggctgtagatcatgacgggaaaggcatgtactcgaccggcttaggccatggggatgccctccatacaggagatcttgatccgggccggccgaggcttgaggtgtttcaagtacatgaggacaaaaatgcaaaatacggcttatctttccgggatgctgcaaccggaaagatcctttggggcgtttatgccggcaaggatgtaggccggggaatggctgctgatattgacccgcgttatccgggacaggaagtgtgggcaaacggttctctctactcagcgaaaggggtcaaaatcggaagcggggttccgtcctcgaccaacttcggtatctggtgggacggcgacctgctgcgggaacagctggacagcaaccgaattgataagtgggattatcaaaacggcgtatcgaaaaatgtgctgactgcatcaggcgcagcggctaacaacggcacaaaagcaacaccggcgcttcaggctgatctgctcggtgactggcgcgaggaagtcgtgtggagaacggaggacagcagtgcactgcgcatttacacgacgaccattccgactgagcacaggctgtatacgctgatgcacgatccggtgtaccggcttggcatcgcctggcaaaatgtcgcctataaccagccgccgcacacaagcttctttttaggagacggcatggcggaacagccaaaaccaaatatgtatacgccttaactgaaagggggaaggaacgggctgcgcgcagcccgttcccatcaaatgaaaccaaaaaagaggcaaatggaatacttgaccagaggtttgattgcggtaaagacagaacagggggtgtttatcagctggcgttttctcggcacggatcataagacgacggcttttcacctttatcgggatggaaagcggatcacccgcgatccaatcgctgaaagcactaattttctcgatcaaaacggaacggctgactctgtttatcaagtggcggctgtcaataaaggacgggaagaaaagctttccaaggaagctcgtgtttggcaggaaaatgttctggaggttccgcttgtcaaaccggaaggcggtgtgacgccggatggaaagccgtacacctacagcgccaatgatgccagcgtcggggatgtggacggggatggagaatatgaaatcatcctgaagtgggacccgtccaattcaaaagacaacgcccatgacgggtataccggggaggtgctcatagatgcctataaactggacggcacctttttgtggcgcatcaacctcggcagaaacatcagagcgggcgctcattacacgcaatttatggtgtatgacctggatggtgacggaaaagcagaaatcgccatgaaaacagctgacggcacaacagatgggaaaggacatatcatcggtgatgagcatgccgattttagaaacgaacagggcagaattttgtccggtccggaatatttgacggtgtttaaaggagaaaccggtgaggcgctcacgaccgtggaatatgaaccgccccgcggcaagctggaggattggggagacggctatggaaaccggatggaccgttttctcgccgggatcgcttatttggatggggagcggccgagccttgttatggcgcgcggctactatacgagaaccgtgctcgtggcatacgatttcagaaacggaaggctcaaaaaacgatgggtatttgactccaaccagccgggacatgaagcatacgcaggacaggggaaccacagcttgagcgtggcggatgtcgatggagacggaaaggatgaaatcatatacggcgcaatggcggtcgatcatgacggaaccggcctgtactcaacggggctcgggcacggagacgcgatgcatgtaggggatctggacccgtcacgaaaagggcttgaagtgttccaggtgcatgaggacgccacgaagccgtacggactgtcactgcgagatgccggaaccggtgagatattatggggcgtccatgctggaactgacgttggccggggcatggcagctcatattgatccaagctacaaagggtcgctcgtctggggaattgatccgccgggcaatgatggcatgtcgtatgggcttttcacgagcaaaggcgaaaaaatcagcgacaaagcgcccgcttcagccaatttcgccatctggtgggacggtgatttggtcagagaactgcttgatcatgactgggacggaacgattggcaggccaaagattgaaaaatgggatgctgaaaacggctgtctgaagacgatatttcagccggccggcgtgctgtccaacaacggcacgaaaggaaacccggttcttcaggccaacctgttcggagactggcgggaagaagtgatatggagaacggaagacagcagcgcgctccgtatctatacaacgacacatctcacccgccaccgcttttacacgctgatgcatgatccagtttacaggctcggcatcgcctggcagaataccgcctacaaccagccgccgcacacgagcttttacctcggaacgggaatgaaaaaaccgccgaagcccgccctgtacatagcgggaagtaaagcggaggcgccgctgtaggaggactaaggataagaagcagctgtataaaaaacgagggggaatgaaaaatggcaaatcatatttatcttgccggcgattcgactgttcaaacgtatggagacagcacaaatcaagggggctgggggcagtttctcggctcgcatttgccggagcatattcaagtgatcaacagagcgatcgggggaagaagctcgaaaacatttgtggaagagggcaggcttcaggcaatccttgatgtgattgagccggatgattggctgttcgtgcagatgggccataatgacgcgtcgaaaaataagccggagcgctacaccgagccctacactacttataaacaatatttaaagcagtatatcgcaggcgcacgggaaaaaggcgcccatccgcttctcattacccccgtagcccgctttcattacgaaaatggcgtgtttttgaacgattttccagattactgcattgccatgaagcagacggctgaagaggagaatgtccagctcattgatctgatggagaaaagccttgctttctttactgagaagggcgaggaaaaagtatacacctattttatgatttcagaagggattaacgattacacgcattttacaaaaaaaggcgcaaatgaaatggcgaaacttgtggcaaaaggcataaaggagctcggcctgccattgacagaatcgatcatcaaagaaaggtgaaaatgtgatgagaaaactgtatcatggcgcttgctattatccggaattatgggatgaggagacgattcagcaggacattgacatcatgcgtgaagttggcgtaaatgttgtgcggatcggcgaatttgcctggtctgtcatggaacctgaagaaggaaaaattgacgtcggttttttcaaagaaatcatcacccggctgtatgatagcgggatcgaaacgattatgtgcacgccgacgcctaccccgccgatttggttctcacatggccggcccgaacgcatgcatgccaatgaaaaaagagagatcatggggcatggctcccgtcagcatgcctgtacgaacaacccgtatttccgaaaaaaagccgccatcatcaccacagccatcgccaaggagcttggccggctcccggggctgatcggatggcagctagacaatgagtttaaatgccatgttgcagaatgcatgtgtgagacatgcttgcgcctatggcatgactggctcaaaaatcgctacggggtaattgagcgcttgaatgaagcttggggaaccgatgtgtggagcgagacctatcagacgtttgagcaagtcccgcagccgggaccggccccgtttctgcatcatgcctctctacgcactatgtatcagctgttttcgatggagatgatcgcttcgtttgcggatgaacaggccaaaatcatccgctgctattcagatgcgccgatcacgcataacggatcagtcatgttcagcgtggacaatgaacgaatgtttcagaatctcgattttgcctcctatgacacgtacgcttcgcaggaaaacgcctctgcctttttattgaactgtgatttatggagaaatctgaaacaggggcgcccgttttggattttggaaacgagtccgtcgtatgccgcctcgcttgaaagctccgcttacccgcacgcagacgggtatttgcaggccgaagccgtatcgtcctacgccttaggaagccagggattttgctactggctatggcgacagcagcgttcaggcagcgagatttcccacggttcggttctcagtgcctggggcgaacccgccattggctaccaaaatgtgctggcggttgagcgggcaagaaaggaaatcgagcctattattctatcgactgaacccgttcaagccgaggcggcgatgacttactctgacagagcaaaagcatttattaaaactgagcctcaccggggactccggcatcgttcgcttgtgacgcatttttatgaacgtattctcaacacggggattcaccgtgaccttattccggaaggcgctccactggacggctatcgcttgctgtttacgccatttgtgccgtatttgtcttctgaatttatcaaaaaagcttcggcattcgctgaagcgggcggcatctggatcacggggccgctgacaggagggcgcacatgcgagcataccattcataccgattgcggacttggcgaacttgagaaaacgtcagggatcaaaacactttttacctttccgatgaatgagaacgtgaatacaggaaaagcgtttggcatcacggcgccgctcggactatggagcgcggtgtttgacacagagagcgggaacacccttggcacggttgaatcaggaccgggggcgggccatgcatttctgacggaacggaattacggcgaggggaaaattgtcatgctgggctcgcttccatccgggaaagaaggggatgcgatgctggaagcgctcgttaggcattacgcggaggaagctgttatttccagccggtcggatgttacgcccggcacgatcgttgccccgcgcaaaggcgataacggccttgtgtggatcatcgtgaatatggatggaaaaggaggaagtgtgacactgccggaagcgggaacagatctgttgacgcaccgcttggaaaaggcggggaggctggcggtcggaccgcatgaataccgtgtgattcaatttgacaatcccagctgattctttgcatcgaatcagcttttttctatggagggagagaccgatgaaaaagatcaaatggttatcaggacagccaaaggtgataagcggcgtgacgtggggcgtgccatggaaaaaaggagaattaaaaaaaggagaccgtctggcgcttatgaatgaaaacgcggaaacgcgatatgtgcaaagcgaaccgtcggcctattggccggacgggagcatcaagtggacgaagcacgcggcggtgtttggcggtcaggaaaaccaaagctttacagttcgcaaaagagaagtgccgcagccaactgaatcgctcagcattcttgagacagagcatgacatccaagtgaatacaggagcactcgtttgtaccattcataaaacaggatctgatttcattcaatcattgcagatcaacggaaagccgatcgccgcaggcgggaggctcgttgcaataagagaaacgagaaaagagtcggcggcggaaacggtttttttgcatgaaaggtctgccagctttatcaaacgggctgcgattgagcagagtggtcctgtcaaagcagtagtcaaaatcgagggagtgcatgtgctccataaaacgaatgaagaatggctgccgtttgtcatccgattgacgttttatgccgggctgtctgagatcggccttgtgcacacgcagctgattgacaggagcggtaaacaagaattcattaaggggctcggcatcgaatttgccctttttttggagggagagccgtacaaccgccatttccgctttgcgggagagaaagggatgtataaagaaccttcccagctgtttggcacacgtaaattcaatgaacgatatccgctttatgaaaaacaaatcaatggcgaaatgctgtctccagatgaagagcataaggaatggtttgcacatggcacacagaatgcggtttgggacgatgtcaagctcgtgcaagattccagcgatcattacagcctgtcaaaacggaccggaaaagattatgcgtgggttggaatgctgcatggcagccgggcgaaggggctctgctatgcgggtggaaaaaatggcggtgtggctctcggcctgcggtatttctttgagaaatatccttcagcactggaaatcacaggtcttgccggcagccgccccaaaatgactatctggctttggcctccggacggcgaagcgatggatttgcggcattatacaggaaacacccacgtggccagcgcgtatgaaggctttgatgaaatgcgctcagatccgacaggcattgcgaacacaaatgaaataagcctggcgtgcttttcgcacatgccgtctgacgaagtcctcgatgcgctcgctgacaaatggcaggcgcccccgctcattgtatgcgagccggacgtctattacgaatcaaaagcactcggggtatggagcatcattgacacatcccatccgctcaaaaaagagctggaagaacagcttgatgcggcctttctgttttataaaaaggaagtagagcaacgcagatggtacggtttttggcattatggcgatgtcatgcatacgtatgacccgatccggcatatgtggcggtacgatctcggcggatacgcatggcaaaacaatgagctcgttccgaccctatggctgtggcaggcgtttttccgctcaggcagagaggatatcttccgaatggcagaagccatgacccgccatacgagtgaaacggacagctttcacctcggtgaatatgccgggcttggctcacggcataatgttgtgcactggggatgcggctgcaaggaagcgagaatcagcatggccgggcttcataaattctattattatctgacgggtgatgaccggacgggagatcttttgacagaagtgaaggatgccgattatgcccttgtcaaaaccgatccgatgcgcgctttttacgagaaaggcaagcacccgactcacgccagaacgggaccggactgggcggcgttttgctcgaactggctggcggaatgggagcggaccgaaaattcggaatatctcaaaaaaatcgaaacgggaatcaactgtctgaagcggctgccgctccgcttattatctggcccgacatttgaatatgatccggcgacctcgatgcttcatcatatgggagacggcattgcgggcggatatcatatgatcattgccttcggcgccccgcaagtgtggatggagctggctgagcttcttgatgactgggaatgggaggatatgctgagtgaattcggcgaattttacacactcagtgatgaggaaaaacgaaaaaaaagcggaggcgctcttcatgacgggcattttcactggccgatgttcgccgccggtatgacagcctacgccgcaagaaaaaaacaagatcctcatctcgccgccaaagcgtggaatcttttgctagaagataagctcagccatacgccgcttccgatcaaacccgagcgcatcgagacatggacgcagctagaggagcttccatgggtgacaacgaacactgtctctcaatggtgtttaaatgtcatagcggcgctggaactgatcggagattcccttccggcaaaaaaagaaacatcgggcaaaaaaggataacagccggaatttcataggagaaatggtgcaaaaaatgaagattgcaagaatttatgtaagcgctttatattgagaggggcaaaggggaaatgcaaattgaaaaaagggggacttacgcaacatgaaaataagaatgcgaaaaaaatggatggccttgccgcttgctgccatgatgatcgccggatgcagccattcggaaacatccaattcagcaagcggttcgaaagatacgatcaaaattatggcgccgcttttatcgccggaaagcccgagtgataaaagcccttcattaaaagcgctcgaaaaatacacaggcaaagagattaaggtcacatgggtgcctgattcatcctacaacgacaaattcaacatcgtcatggcttcaggagagatgcctcacgcgattgtcattaaagataagtcagccggctttatcaagtctgtcaaagcaggggcgttttgggaactgtctccttatttaaaagactacaagaatttaagccaggcagatgaaaagattttgaagaacagctcggtgaacggcgaggtgtacggaatctacagaacgagggatctgatcagggcgtgtatgatcatcagaaccgactggctgaaaaatgtcggtctggatatgccggaaacgcttgatgatttctatgaagtgctgaaagcctttaaggaaaaagatcctgacggaaacggcaaggatgatacgtacggcatggtcgtgccgaaatggatgggactcggcaacggaagcccatgggatgttctgcaaatctggttcggcgctccgaaccgctacggtgttgaaaacggaaagctgattccagattttacaacgaaggaatacatgaatgcgctcacgttttttaaaaagctctatgatgagggattgatcaataaggattttgctgtcatggattctgcgaagtggaatgatccggttgtaaaaggaaaagcgggtgtcatcgttgatacaggctcaagagcgtctcaaatccaaagcgcgatggaggaggcggatgagtcgaacaaggatatcattgatatcgtcggctcgcttgagggaccgaatggcaagcgcactttcccgacatctggttattcaggcatgatcacgataccaaaatcaagcgtcaaaaccgaaaaagagctgaaagaggtgctgtccttcctcgataagatgaatgataaggaagcgcagattctcacgaacaacggagtgaagggccgcaattacgagctcaaggacggcgtattcacctcacttgaaaaaaacaacaaatctctcctgtatgagcatgaaggcttggcacagttcagcatgtcgattccgaaaagtgagtattacatcgaagaccagaaaaccaagctcttccagcatcgcaaggacatcataaccgaaggagaaaaaatagccgtctttaacccggctgagtcgcttgtatctgatgtctatacccaaaaaggagcccagcttgacaacatcatcctcgacgcgagaacacaatttatcattggagaaattgatgaaaaagggtttgctgatgcagtggagctttggaaaaaaagcggcggcaatgacctgatgaaggacttgaacaaattgtaccaatcgtcaaaataaaccgatgcgcctgcctttcggcgggcgccccggtaacacgaaaggagaacagatatggaaacagtgccgaagaagggagattcacctgttctcaccgctggaaaaggcatcagctggatggctgcgctcaaacgggacaaatggctttatcttcttcttattcccggtctgctttattttttgatttttaaatacttgccgatgtggggcgtgctgatcgcttttaaagactactcgccatatctcggcttctggaaaagcgaatgggtcggctttgattatttcaaagacttttttatgaatccggattttttccggctgctgcgcaacaccctcatgctggcgagcctggatcttttgtttgcctttcccgcgcctctcattttagccctgcttttgaatgaggtaagaaaggccgcgtataaaagatgtatccaaacctttatttacgtaccccattttgtatcatggacaattgtggtcagcatcaccttcgttttctttactgtcgatacaggtgtgatcaacaaaatgatcatgagcctgacaggtgagcagatttctttcttgtcggatgcagactggttccggccgatgattgtgatgcaaagcatttggaaggaaacaggctggggaacgattctatttttggcagcgctcgctacggttgatcaagagcagtatgaagcggccatcatggacggagcggggcggttcaggagaatgtggcatattacgctgccggcgatcagaagcaccattatcgttttgttgattttaagaatcggcagctttttgaatcttggctttgaacaggtgtatttgatgacgaactcactcaaccgcagtgtggctgacatcttcgacacgtatgtgtatatgatggggattacccaaggggcgtatagctacagcacggcggtcggtttgtttaaatcagttgtcgggattatcttgatttttggagccaattacattgcgaaaaagtttgatcaggaaggattgttttagaggagggagaggtatggctgaaattcacacgatgcacaacaccaaagccggacgggtgtttgacgtctgcaacattctgtttctcggcggtgtcggcgcgattaccattttgccgtttttatatattatcgccggttcctttgcgacagaagcggaactcgcccagcggagcttctttattttcccgaaaacctttacacttgatgcttacaagtatgtgttttcgacaccaacgttccttcgaagcatgggtgtgtccatcttcatcacggtggtcgggacggctgtacagctgtttttcaccttcacgatggcatatccgctggcgaagcggcatgtgaagggacggaatctgctgttgaatctggtgattttctccatgctgttttcaggcggcatgattccgacgtaccttgtcgtaaaatcacttggccttttggatacgtattgggcattgattctgccgatggcgattaatccgttcaaccttattattatcaaaaacttctttcagcagctgccgcgcgagctggaggaatcagcaaaaattgacggctgttccgaaatcggcgtcttctggcggatcgccctgccactgtcaaagccagttattgcgacctttgcgctgttttatgcggtcgggatttggaatgatttcttccacgctctcttatatatcaatgacagtgcaaaatggccgctgcaaatggtgcttcgccaagtcacaattttatcggatttaacggcgaccaatggtgatacgatgcaaaatgcagttccgccggagcagggaattaaactcgctgtcattgtcattgcgacgctgccgattttggcggtctatccatttttacaaaaacactttgcaaaaggaatgctgatcggttcggtgaaaggctgagaaagggagtgtttcatatcagtacattagatcagattaagattgcctatatcggcggggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgctgatatcgtcattatttccattttgccgggatcactggatgatatggaagtcgatgtccacttgcctgagcgctgcggtatttatcagtctgtaggtgatactgtcgggcctggagggatcatcaggggcttgcgtgctgtgccgatatttgcggaaattgcccgggcaataagagactacgcacctgaatcatgggtcattaattatacaaacccgatgtctgtctgtacaagagtgctgtataaagtgtttcccggaatcaaagcgattggctgctgccacgaggtattcgggacgcaaaagctattggcggaaatggtcacggaaaggctggggatagaggtgccgcggcgtgaggatatccgcgttaatgtgctcggcattaaccattttacatggatcacaaaagcctcttaccgccatattgacctgctgcctatattccgtgaattcagcgcgcactatggggaatcaggatatgagctggagggggaaagctggagggacagcgtcttttgttcggcacaccgtgttgcgtttaatttatttgaaacgtatggcgccatccctgctgcaggagacaggcatctggcagagtttcttcccggcccatacctcaaacagcctgaagtatggaaatttcatctcacacctatatcattcagaaaaaaagacagagctgagaaacgacaagaaacagaacggttgatcgtgcaacaacggggcgttgctgagaaagcttcgggagaagaaggcgtgaacatcatagcggctcttctcggattgggtgaactcgtcacaaatgtaaatatgccgaatcaaggccaggtctcaaaccttcctatacaagccattgtcgaaacaaacgcattcatcacaaggaaccgtgtccagccgattttttccggagcgcttccgaaaggtgtggaaatgctggcggctaggcatatatccaatcaagaggcagtgtcggaagcaggtctaacaaaggatactggcctcgcgtttcaagctttcctcaatgacccgcttgtcaggattgaccgcagtgatgcagagcagcttttcaatgacatgctccaatgcaccatgcaacgttgagcggagcttttccggtttagaaaagaaaccattgaccatactgatagtataatcaagaagtaggtgctatcaatatgggagattatttaagtgttgcggtagaattggtctgcggtttaggcattttatttattatcttaaagcttctcgggaaaacccaattttctcaaattacgccgtttgactttatttctgctttaattttaggagaattggtcggaaatgccgtctacgatcatgatatcaaaataaaagaaatcatttttgcttcgctgctgtggggcgtgctgatttatgttattgaatttatcacgcaaaaaatgaaatcatcgcgaaagttcttggagggtgagccgaatatcgtcatccgcaaaggagagcttcaatataaagtaatgaagaaaaataagatagacattaaccagctgcaaagcctattgaggcaagcggggagtttttcgatccaagaagtagaatatgcgattcttgaaacaaacgggatggtcagcgtgcttccaaaatcagactttgacaaaccgacaaataaggatttgcagattccttcgaagtccgtttctctgccgatcacgttaatcatagatggagagattgtgcgggataatttgaaggaagcaggtgtggatgaacagtggctgaaacaagaattgaaaaagaagaacattgataagacagaggacgtgttatttgcagaatggcataaaaataagccgctgtatactgtaacgtacgaacaaagcagatcaacatgactcttagaaaaaagcttgcagcaaggcgcaagctttttattgattgtatgtcccttgtttgacagcacgtacatggtacatgctcacttcagtgctgatcagatagtcaggctttggtttgcctttgtttgctttatggccggcgatatgcgcatcgcttttttcccattgcttccagtgatcctctgattcccagcgaatcatgacaacaacttcttcatcaccgcggcgcacatttttctcaagcactgtcacatcaattaaaccttcttgtttttcaatgattccttcagcgctgaaacgttctataactttatctgcaaagccttctttaaccgtcatttttctcaactgtacaaacatttgtctcactccaatcattctcacatatgaataattgtaaatgaaattcattctcaatgtcaaagaaagcgcaggacggaatcgaaccgccgtgcgcaacagtttattcttttaatagaaacacatttccgtcttcgtccttaaattgaacgaaggtgccccactccatttgattgggctcaccgagaaattctacaccgtttgtcttcattttctcgtatgtaccaaagatgtcttcgcattcaaacacaatagaagccttcatttgctctgagcctttcatcatggctttcgggtaaatgactaaacgagtctcggccccttttggcgcaacctccagccagcttgcttcaggtcccattgggtggtccgctgcaatatcaaagcctaccttctctgtccaaaattgcttcgctttctgctggtcctcgacatatacagcaacagtgccaatttgtttgatcatagggaaacctccgagttgaaaagataataatactataacctgtttacggccgaagtaacataaaaaaatcagccgggaaaccggctgatttttaaaatgagcagcttacaacatcgatgtgatttgtgtctaaggcgaaataaacccagcggcgccgtgaggaatcccaataaaagccgccgacagaccttctgccaaggatgatcgggtaaaaccaaaaggagcggccattggttaaccaaacataggtaaatcggaaaaggcaaggacgaatggtgattggttcaactaacaaaacggctccttgagaaccctgcggttttgggggtttcgctggtatttgggaaggaggaggtccctgcggcgcaccgccgaagcctgggctggcaccgctgccaataccagggccggagccgccgccaaagcctggaacagcgccaccgccaataccagggccggagccgccgccaaagcctggaacagcgccaccgccaatgccagggccggagccgccgccgaagcccggaacagcgccgctgccaatgccaggccatggatatcggtattcatattcaaaagcaggccaaggctcataaaaatgccccgcaaacatataaggatcaacataatacatgtgataacgtcctttctcattgtaaactgtacattgcagtttatgcgggcggactcttattggtgcattcgcctaaggatatgaagcaggaatgctctcagagagcagaatcatttgatttttctctagtcttattcacaattccgatttatcattttataatgaaagtgcttctattacgaaaaaggagacagaccgtgaatatcgatcaattattatatcaatatatcatagacaacactgcggatattactgagaaatggttcagtttgcgttgccagctaaaaggcgagctatattccgccagccatttaagtgaagaaacgaaaacacttttaaccgagcagcatacatttaccaatataacaatcgcaagcgcatttctggaggatcaaaccgattttcaagaaaacatgacaaaatgggcggaaaacgttgcgaaaaacagggtagagcaggatgttcaagtgcatgaggtcgtagaagccatatccaattctagaatctcattctgggacgcagtcgccacatttataaaagagaatcaggagattgtgacaaatgaggatgcagaccgatggaaccgcattgtgaaccagtcgttcgataagctgattattgaattctccgagcagtaccaaaaattcatgctgatgaggctcacatctcagcaggaactgatctcagagcttggctgtccggtaatttccattgccgatggaatcgggatattgccgcttatcggctccattgatacaaaacgggcacaggtcattttagaaacagtgccggtccgctgtgtcgagagaaaaatcacaagccttgtcgttgacctttcgggtgttccgattgtggataccatggtggctcagcaattgtacaacctgtctaaaacgcttttcttattaggcgtcaaagccgtattttcagggattcgcccggatgtggcccaaacatcgattcaattggggcttgattttagtgaatatgaaacgtatggcacgctgaagcaggcattagaaaacatgggtgtccgctgtattgttgaggaattggaagaaaacaaatagggagtttctaggcatatgatcgtccgtcaccgggtgatcatatgcctttttgatttgaacagaaatcaccattgatttatcgaaaaaaacataatattataattcttataagaatactgtgaattaaaacctattcaacaggggggaaggtcttttggtttcaaaattaacgattgatccggaagtgattgaaaaaattatcagctcgctggaaacactcgatttcggcaccgttcagattacggttcatgattctcaggttacccaaattgagaaaatagaaaagcaccgtttttcgctgaaaaggaaagaatcaaaatgataatgtaaagggcgtttgttttcattaaattctccttaaaacatatacatatttcatccaatttttatataatagacctttaagatcattttttaggaggatttttgacatgcaagctacggttcacgagagtaagcaatcgatcatgcaacgcattttgacagtctttgtcttcacattgctgatcgcgactgtcggcctttttatcggccaatttgttcctgtcgctttgatgctgccgctttctattcttgaagtggcgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgctcgaagcctttggttctacatttgtcatttttgccgtcttaggcacaatcggcgcaaaaatgaagaaggatttatccttcctgtggtcgtttctgctggttgcggtgctcgcactcgcagtggtagggattttcaacattttcagcccgttaaactcagcggcgatgatggcgtattccgtgatcggaaccatcgtcttttccctttacattttgtatgatttgaaccaaatcaaacaccgccacattacggaagacttgattcccgttatggcattatcgctgtaccttgactttatcaacttattcatcaacctgctccgcttcttcggcattttgagcagtgatgattaatgaaaaagcgcctgtcattggataggcgttttttgccatacacaaaaaggcaggtggagtattgatgaaaaaacaaatgggcgcatatgcatctctggcagctgctatggcaatcgtcggcagctctgtcgttgtcggcaagctgatggtcgaacggattccggtctttctttcctccggattgcggtttttgatcgcttctgtcgtattgctcacgctgctgttttgcattgaaaaagggtttccggctttgacgaaaaaagatgtgttcgtattgctggtgcaatcattcacaggcgtgtttttgttcagtatttgcctgctgtatggggttcaatatactacgggaacggaaagcggcattttgacaagcacaacccccatggtgatcggtattttatcctttttcctacttagagaaaaaattgagaaaaagacgctgatcggcattttgctggcggtttgcggcgtaatggcgattaatttgtttggagcggggagccaagacgggacgccgcacgccttattcgggaacatgctgatcattgctgcagtcattggcgaagcgttgtttacattgatggccaagctgctatccccgcatatttcggcactggcgatttcgaccttcgtatcgctcttcggcttcctgttttttctcccgtttgctttgtttgaggcctcttcatttgattacagcgtgccgactgttttggattggtcgtatgtgctgtattacgcgctttttgtcactgttttggcgttttacttatggtatagcggggtgacgaaggtgccggcgggtgtatcgggcattttcacatccgttcttccggtctccgctgtcattttgtcaggcgtgatattgaaggagccatttgagtttgtgcatttcatcggcattgcatgtgtcatcggcggcatatttgttacggtcataaagaaaaaacagccggatgcgtatccggctgcagaagaaaagacgctatagcctgtccagatcggacgggttttttagtctttaaacacgctcagcctttcaaaaagatcaccaagcatctttacgaacatgcctttttcctcgtcgctgtagttttccatgaccgctgagattttgctgaaatggccgggcagaaattcctcaaggcgtgctttgccttccgttgtcagttcaatgctgatttttcgtttatcctctgtgtgatgcctgcggctgacaaaaccgtccctcgccagcccgtccagcaggcctgtaatcgtcgctttcgtgacgtttgactgtttggcaagctctgtcggacttaacctatgatccttggcatcaaagagcagcatcaggattttgaattttccttctgacagccctcggccagcaaagtaatgctccatcacatgattcattttttttgaaatatcaaaaagagataaaaacaattcaagagagccggcgtcaatattggcatacgtttcggcgtgctctgttatatgcttatatttcggtaaatgttttaattccatcgcaagtagctcccgtacattcgttgtgacacgattataaaggagggaaaaccataacgcaacttggcttggagatgattgacagattttcttgggacatagtaaggtaatatagttaggcgcctaactaatacatatagagctgaaaaggtggttattgatatgaaacatatgttaattgcaggaggcggcatcggcggcttgtcagcggccatttctctccgtaaggcagggttttccgtcaccttatgtgaagcggcttcagaaaaccgaaaaacaggtgcggggattcttcagccgcaaaacgcactggcggtgttgaaagaactgggcgtattcgaagagtgctgtaagcacggctttcaaacagaatggtttaaaacgtttgatgaacaggggaatttgctgtttcaagtcagtgaatcctttttagacgattcacttccgggacgcaataatatcctgcgcaaaacgttaaatgacattctcatgaagcatgccgaggcagtgggtgtagacatcaagtgggggaaaaagattgtcgcctatgaagaaacagctgaatcggtcactgccgtatatgaagatggggaaaagatgcaggctgacattctggcgggctttgacggcattcactccgttgttcgcgatataatgctgcaaaaggagacggaaaaagagcatctcggcatgggagcgtggcgcttttatatcgaacttcctgattacacattcgaggacgcaacattcatgtatagaagcggagacacacaaattggggtggtgccattggcggaacacgctggctatgtcttcgtcctccagccttgcacgagcgattactgggatgaggaagatacccggtttgatagagtaaaagagattctttctggttttcgggggctggattttgtcacaaagcacatgtcaaaacagcatcctgtcatctttaacaaactggagcaggtcgccgtgcaggagccatggcataaaggccgcgttgtcatcggaggagacgccgcccacgccggcgcgccgaccctggcgcaaggagcggcaatggcgatcgaggatgccatcgtcctcgccgaagaactccaaaaccacgccgaccacgaaacagcattacaggcgtactacaaaagaagagccccacgagcgctcaaagtccagaacctatcatcggaaatcgtccgccgtgggctgaaaggagagccgggagcggaagaactgattggggaatgctatgcggtgttgagggaaggatattaaataggaaaagtccagaaagtgatttctggactttttagtcttgctctgttttattccttatccgctcaatcacctcatgcagcccctcaggcttataaaactccaccggcgaactgcccttctcaaacgaaatcgtctcagcttcaatcagcgttaatcatcttcatctagaaatagtttaggtttaatatcttccctgcaaataaagtctgatatgtaataggaaaattatacattttgaattataattattttatatacggaggcgattaatttgttagataagtatgattatattgaaggcattattactgacttaaaaggtacaactgatttaaactttcaaataaaaataggtgaagttttaaaagtttattgtaagtctaaaaaactaacatatgagatgccgaactcttctggaggagatgataaaaatgatggttggatagttgaacttaaaaggttttatcaaatttattctcctcagcaattaagagactctttaaagaaagatattcaaaaaaaattcacggaagatttagataagttattggagcttttatatgttaagggaaaatggaatggggaaattgatgattttatttttatagttaatacaatagatagaaatcttcctcatgatagtgaaagatactttgaaagtgaaaggataaagtttgaaggtatttataatatttctttcaatgtagaagtagttaacgtagattatataagggatttactagaagaacttaatttgaacgaattaagcagcttgagttcacgattgaaagtgaaatcaataattgattataatgccatgaactctaagctgttttatgaatttatagatatattaaatgaaagtattcaaaataaatttagagggaaaataaaaacaaatagctcagattataaacgactctcatcaccttctaaaataacaaagaataatttaaatgatgttgaagaagagatcgaagatataatgttagaattacatctcttagatgaaatcgttagtacggtttaccaagatattaattatactgataaatttgaacgtgttgtttcatatataattcaggaatatcaagacctttcccaagagtttgcaggagtagaactgtataaaaaaatcattgataacctaattaagtttgtggaatatagaagaagttttgaattcccagcaaagatgttaatagtatatatatttgataaatgtgatattttcgaaaaagaagaagtgagtgttaaagtatgatattacctaataagtatgtaccgaattcagaaagccttataggtctaggtgcactaattttaaatgttttaggaaaaaaatctatacctttagataaattatggaagttatttgagaaaaaatacattagcgacaaattaaataatcctccgacctatcaaaagttcattttaacattaaatttaatgttcatggtggggatgattcagtatactgacgaaggagaaatttataatgaaaatattaaagctagtcgtaaataaaccaaatggtgaaaagattagagaaattcagtttgagaaaaaaggattatcaattatttatggcaaagtgaataaacctaacgaagagaaagaaacttcaaacagtataggcaaaacattattattaaagtttattgattacatattcggtgctaacgaaagtatagaaattataaaaccacaaattcatgggtggtacttagaagcagtaatagaatataagaataaaaagtataatgttaagcgaatattaggaaattcagaaataatagttgatgaagaaaaatatgagttaagtaaatataaaaaacggtttaatattgatagaaaactatacaataagcaagtttttttaacacaaaaggctcatttaattagcggtcgtagtgatgcaagtttagatgattataccaccttatttaaactgttagatttggaaaatttatcagatgagtcggtggaatattatgaaattcaaaataggattaaagaattaactacacttgaaaaaaaggttatgcagttttttgatggaattaacatatctcaaattgaagagaagattttcttaattaagaaatcaattagcgaaaaagaaaaagaactaaaattattagatgaacgaataactaacatacaaatcggaaaagaaaaatctgagttaatggatgaatatgctgataaaaattataaactaaaattattacaggttgattatcaaaaattaaatcttgaatatagaaggttatctaaatcattagatgaactaaaaaatgttgatatttcatctcaagacataaaaaaactatacgatagagcaaaatttgaaattcccgatttaatagttaaaagattagaggaggtcgaaaattttcaaaaaaatgtatatgcagataggaagaaattaactgaggcaaaattaaaagaagttttatataaacaatctattataaaaaaggatattagtaacctcgagaatgagatagaaaaacttgcgaatataatatctcaaaatgaaatttatcaagaatcaatggctatatataaagaaaaaagtatggaattacaaaatcttatgtataaacaaggagaattatcaaagattgataaaataataaaacagagaatagatgaagaaattaacctgacgacaaaatatagtgatgtaaaagatgtttatacaaattatgataagatcataaataaatataaaaatttcatttatgaaatggttcataatatttatacggataaagttgaagcttacttctcaataaagttaaaaaatcgtcataaaagaaacagaccatttgctattgagttaaatttaacaggtgatactggggagggtgtgggggaagttcgaaagttattaatagacttattgatcctcagatataataaatatttaagcgttttattacaagactcttcatgtttttcagggattgataatagacaagtctctaatttaattaaattaggacacaaaataagttgtaaggtggataaacaatatattatttcgataaacgactatcagctaaataaaaaagatggcgaattaatagaacttattaataattacacgaaattagaattggatgaaaataataagttactaaagtttgatttttaataaacaactagatgtgtaatcttggcaagctttatttatcagcatggtctcgggagtgtcctagatgattcgggccgaggcattgatataggaaaagtccagaaagtgatttctggacttttttattcttgctctgttttattccttatccgctcaatcacctcatgcagtccctcaggcttataaaactccaccggagaactgcctttctcaaacgaaattgtctcggcttcaatcagtgcgacatagcgcccgtttactttggcgagatgaatagaatcgccaaaatccgctagcaatcccttaatctctgtttctccgactttcattttcagctgggcctctggcgtgtgctcgatgatttgggcggaggcttcgatgacttgatgggtgtcgaggcgctcttggatttcccgcttttcgcttgcttcccaaatctcaatgtcgtgctcgaactgcttgagctcttcgctgttgtcttcaaatgtctcgtagacgtgctcctgtaccatgttcatgacctggtttttcatgatttccggcatcgattctccgtactcgacgaatttcagaaagtcctcaaaatagcgggcgtgtgaggcctggtggattttcagttcaccttcctcgaccattccttcctctggcatgtacgggtattggatgcttttcatgttttttgtcgtgatcgccatttcgacttttttaatgagagaagacgcgtcagagatgcgggcgaccttcggctcaaaatcacatttcataatgaagacaaatgactcgtcaaagtattttctcggtacggccgaagcgacgagaaacacgccgccgcgaaccgcgcttgtgtcaaggtacgtgcggacgaactgctcgctcagctcattgaagtcttcttttgtttccgccagacgcgcgcggttgaacatgttgtagtttgggttggaatcgagctcgtggccgggctcgacgataaaatggccgattttcgtcggcacctgctcggactgcggatggcggtctgctttccgtttgacgatttttttcagttccccgtcgagaaagtccttcagctcgctttcttcaaattcgcccgtatcaagggtctggaagtgcttgaactgcttgttcgcctgctcatctttgccttccacctgtatgacataaaaggataaaaaccgaatttcaaaatccatatataaactcaccttattcgcgtattgtacagcttctcaagtatagaaaaaacagcgatcatgcgtcaattgggagaacggaataatcatgaccatgaaagggaaatgtagtcaaatagaaggcatctcatacggaaaggaatggttcgatgaaggaaacaagcccgattcctcaaccgaagacgtttgggccgctcggcaatttgcctttaatcgataaagacaagccgacgctttcgctgatcaaactggcggaagaacagggcccgatttttcaaatccatacacccgcgggcacgaccattgtagtgtccggccacgaattggtgaaagaggtttgtgatgaagaacggtttgataaaagcattgaaggcgccttggaaaaggttcgcgcattttccggtgacggattgtttacgagctggacgcatgagcctaactggagaaaagcgcacaacattttgatgccgacgttcagccagcgggccatgaaggactatcatgagaaaatggtcgatatcgctgttcagctcattcaaaaatgggcaaggctcaacccgaatgaagcagtcgatgtcccgggagatatgacccggctgacgctcgacaccattgggctatgcgggtttaactaccgctttaacagttactacagagaaacgccccacccgtttatcaacagcatggtgcgggcgcttgatgaagcgatgcatcaaatgcagcggcttgatgttcaagataagcttatggtcagaacaaagcggcaattccaccatgatattcaaacgatgttttcgttagtcgacagcattattgcagagcgcagatcgaatggagaccaggatgaaaaagatttgctcgcccgcatgctgaatgtggaagatccggaaacgggtgaaaagctcgacgacgaaaatatccgctttcaaattattacgtttttgattgccggccatgaaacaacgagtggcctgctttcctttgcgacttattttttattgaagcatcctgacaaactgaaaaaggcgtatgaagaggtcgatcgggtgctgacagatgcagcgccgacctataaacaagtgctggagcttacatacatacggatgattttaaatgaatcactgcgcttatggccgacagctccggctttcagcctttatccaaaagaagacacagtcattggcgggaaatttccgatcacgacgaatgacagaatttctgtgctgattccgcagcttcatcgtgatcgagacgcttggggaaaggacgcagaagaattccggccggaacggtttgagcatcaggaccaagtgcctcatcatgcgtacaaaccattcggaaatggacaacgggcctgtatcggcatgcagtttgcccttcatgaagccacacttgtgttaggcatgattctaaaatatttcacattgattgatcatgagaattatgagcttgatatcaaacaaaccttaacacttaagccgggcgattttcacatcagggttcaaagccgtaatcaggatgccattcatgcagacgtccaggcagctgaaaaagccgcgtctgatgagcaaaaggagaaaacggaagcaaagggcacatcagtcatcggtcttaacaaccgcccgcttctcgtgctgtacggctcagataccggcaccgcagaaggcgtcgcccgggagcttgcggatactgccagtcttcacggcgtaaggacagagacagcacctctgaacgaccggattggaaagctgccgaaagagggagcggttgtcattgtgacctcgtcttataatggaaaaccgccaagcaatgccggacaattcgtgcagtggcttcaagaaatcaaaccgggtgagcttgagggcgtccattacgcggtatttggctgcggcgaccacaactgggcgagcacgtatcaatacgtgccgagattcattgatgagcagcttgcggagaaaggcgcgactcggttttctgcgcgcggagaaggtgatgtcagcggtgattttgaagggcagcttgacgagtggaaaaaaagcatgtgggcggacgccattaaggcattcggactggagctgaatgaaaacgccgataaggaacgaagcacgctaagccttcagtttgtcagagggctgggcgagtctccgctggctagatcgtacgaagcctctcacgcatccattgccgaaaatcgtgaactccagtccgcggacagcgatcgaagcacccgccatatcgaaatcgcattgccgccggatgttgaatatcaagagggcgaccatcttggcgtattgccaaaaaacagccaaaccaatgtcagccggattcttcacagattcggtttgaagggaaccgaccaagtgacattgtcggcaagcggccacagtgcggggcatctgccattgggccgtcctgtcagcctgcatgatcttctcagctacagcgtcgaggtgcaggaagcagccacaagagcgcaaatacgtgaactggcggcatttacagtgtgtccgccgcataggcgcgaattagaagaactgtcagcagagggtgtttatcaggagcaaatattgaaaaaacgaatttccatgctggatctgcttgaaaagtacgaagcgtgcgacatgccgtttgaacgatttttagagcttttacgtccgttaaaaccgagatattattcaatttcaagctctccaagagtgaatccgcggctagcatcgatcacagtcggcgtcgtgcgcggccctgcgtggagcggccgtggcgaatacaggggcgtggcttcaaatgatttagctgagcgccaagccggtgatgatctcgtgatgtttgtacgcacaccagaatctcggtttcagcttccagaagaccctgaaacgccaatcattatggtcggacctggcacgggagtcgcgccatttcgcggtttccttcaagcccgcgaagttttaaagcgggaggggaaaacgctcggtgaagctcatctctattttggatgcagaaacgatcgtgattttatataccgcgatgagcttgagcagtttgaaaaagacggaatcgtcactgtccacacagccttttcccgcaaagaaggcatgccgaaaacgtatgtccagcatgtcatggctgaccatgcagaaacgttaatatcgatccttgaccgcggaggcaggctttatgtatgcggtgacggcagcaaaatggccccggatgtggaggcggcactgcaaaaggcgtatcagtctgtccatggcaccggggagcaagaagcgcaaaactggctgagacatctgcaggataccggtatgtacgctaaggatgtctgggcagggatatagataaagaagactggagacatccagtctttcagcgtgtcggcaaaccctcgcattcgttgtcaggactgcgcttcggtgctcaatgcgaagtggatcaacggctaaattctcaggcgtcctgcctaaacgccgtcgtcatcacatcctgtgaatatccgctcctatgctcgtccttcctagacttcaagggttttcaatcacgctgaaaagatgacaaaatcctaaaatggttttcattttaggattttgtcaacaatctggaagactggagacatccagtcttttttgtcctttcgaaaaaatggtgatcgcgctaaacattgatgcatacaataacttcagtccgccggaagggcgggctgtctgcaaaacctatttttcgtttttgctagtttatgttattcttatactcggtatctatttcttttttcaaaggcacacatgacaaaagaaatcctttttttatttcggagaaaaaaatgtgaaacgaaatgaaggtttctttcgtccagtgattggtttccaaatggttgtaataaaaatgatatggtgcgtaacataaatattccggcttgccgcggtgtatttcttgttgtgtgatgccttgattttgtttggaaagaaggaattggaaggcaggatataaagagcaggtaaatatgaatgaagaacttaaagtgtttaagaaagtagaggttgccatgaagaaacttttttcttacaaacttagcttttttgtgctggctgttatactgttttgggcaaaaacgtatttatcctacaagactgagtttaatcttggggtaaaaggcacaactcaggagatcctcctgatatttaacccattctcaagcgccgtcttctttttaggactggctttgctggcgaaagggcgtaaatcagccattattatgctgattatcgatttcttgatgacatttgtgttatatgcaaatattttattctatcgtttctttgacgatttcttgacgttcccgaacattaaacagtctggaaacgttggaaacatgggagacgggattttcagtatcatggccggtcatgatattttctatttcttagatattatcattttgattgcggtattgatctggagacctgaattaaaagaatacaaaatgaaaaaacgctttgcatctttagtgatcctttctgggatcgcactgtttttcatcaacctgcactatgcggaaaaagaccgtccgcagctgctgacaagaacgtttgaccgcaattatattgtgaaatatttaggtttatacaactacaccatttatgacggtgtacagacggctcaaacagaaacgcaacgggcctatgcaagcagcgatgatttaacaagcgtcgagaattacacgacgtctcattatgcgaaaccgaacgccgagtacttcggctctgccaaaggcaaaaatatcattaaaattcacctcgaaagcttccagtcattcctgattgactacaagctaaacggtgaagaggtgacgcctttcttaaataagcttgcgcacggcggggaagatgtgacgtattttgataacttcttccatcagacaggccagggaaaaacatctgatgccgagctgacaatggataactcgatcttcggtcttcctgaaggctccgcgtttgtgacgaaaggcgaaaacacctaccagtcgcttcctgcgattttagaccagaaggaaggctatacaagcgccgtcctgcatggtgattacaaatcgttctggaaccgtgaccagatttacaaacatatcggatacgacaagttctttgacgcaagcacgtacgatatgtcggatgaaaatgtgattaacatgggacttaaggataagccgttctttactgaatcgattccaaagcttgaatctcttaaacagccgttttacgcgcatttgattacattgacaaaccattatccgtttaacttagatgaaaaagacgcgtctcttaaaaaagcgacaactggcgataacacagttgacagctacttccagacagcgcgttaccttgacgaagcgcttgagcaattcttcaaggagctgaaggaagccggcctgtatgacaactcagtcatcatgatttacggtgaccataacggtatttctgaaaaccataaccgagcgatgaaagagattcttggaaaagagatcacagattatcaaaacgcacagaaccagcgtgtgccgctgatgatccgcgttcctggcaaaaaaggcggagtgaaccatacgtatggcggcgaaattgacgtcatgccgacacttctgcacttagaaggaattgattctcagaaatacatcaactttggtactgacttattctctaaagaccacgacgatacagtggcattcagaaacggagacttcgtaacgccgaagtacacatcagtcgacaatatcatttacgatacgaagacaggtgaaaaactgaaagcgaatgaagaaacgaagaatctgaaaacaagagtgaaccagcagctgagcctttcagacagtgtcctgtacaaagacttgctgaggttccataaactaaatgatttcaaagctgttgatccgtcagactatcattacggcaaggaaaaagaaatcaaataagatgaaaaagagccttgagcgggcgcattgccttcgctcaaggctctttttttggttatacaaccaacttgaaaaaatagattccatttggtcaccaaggctggctttctctcatatcattacagtagattttgaaaccggattgaaatcggacaaattatcggggaaatgccttgatagattgtgaagatgtaccaggtttcgaactcaatattcatagagatgaggggtagagatgaaggcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgcttttgggctataaaggagaaaaaatcaaggaatactttctcgactatgaatggaagcacaacagcctgacactcgacagctctacgggagaggtacagatgctgggacagcctgaaacgtggaaaattacgtttttggagactggggaagatacgctgacagccggaagaatcttgcaggcgaaagactatatcggtgatgaaacatttctgcttacctatggggacgggctggccaatatcaatcttttccatctcatcagctatcatcagacaaaaggtgctgccgcgactgtcaccggcattgacaaagtctcgcagtttggcaccttgacggttgaggacggcatggcgaaaacattttctgagaagacatcaagtgacggaatcatcaacggcggattcttcgttctcagtccaaaggttttcgagtatttgccgaaggacgggaacgcgatgttcgaagatgaaccgctgaagaaccttgccaaagacggggagcttgctgtgtaccgccattacggattttggacggccatcgatacgtataaaaatctcttagaagtcaacaaaatgtggaatcaaggacaacaagtatggaaggtatggtgaatcgatttgagtttctggaaaaataaaaacgtatttgtcacgggatccacaggtcttttaggaagctatttggtgaaagagctgatcgatcagggcgcaaacgttacggggcttgtcagggatcatgtgcctcaatccaatctttatcagggagaacatatcaagaaaatgaatatcgtgcggggctctcttgaggacttggctgtgattgaacgcgcgcttggcgagtatgagatcgacactgtctttcatctcgctgcacaagcgattgtcggcgtagcaaaccgcaacccgatttctacctttgaagcgaatatcctcggcacctggaatattctcgaagcctgccgcaagcatccgttaattaagcgggtcattgtcgcttcaagtgataaagcttacggcgatcaagaaaaccttccatacgatgaaaacatgccgctgcaaggcaagcacccgtacgacgtctcaaaaagctgcgcagatctgatcagccacacctattttcacacgtacgggcttccggtctgcattacgcgctgcggaaacttatacggcggcggagatttgaacttcaaccgcatcattcctcagacgattcagcttgtgctgaacggggaagcgccggaaatccgaagcgacggcacatttgtacgggactacttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacactattgatgagggacttgaaaaaacgattgagtggtatacggaattcttcaaaaagtaatgtgaaacgaggtgaacaagactgtgaccagcgcgtattgcaccgttttatcaaaaggaagattatatcaggcagtcgctttgtttaagtcgttagagcaagttgatcaagacagtcccatttttatactttgcatggatgaagatacgcaccgcgtgttacagaagctgaagatgaagcagctgaaccttgtgccggtggccgctcttgaaaatgaattgctgctgaagctgaaggaaactagagatcaaagtgagtattgctggacgatgaagccgatctttctgcaagctgtgctgaacagcaatcccgagctggagcgcgtgacgtatattgacggggacctctttttctatgcagatccatcgccgatttttgaaaaccagccggactgctcggtgctgctttcacggggggatattgtaatcccttcttttgagaaagagcagattgacatgctgcagcgtcttttaggcagatataattccgggtttatcagcttcaagcatgatgatgcaggcacggattgcttggagtggtggaaggaacgctgtcttgaggaatgcaaaaatgcaccgggtgaagggaaattcggtgatcagggctatttggattatatgtctgagctgtttccgaatgtgtgtgacattacaacacccggcgtgaacatcggccattggaattatggacagcatacgttttcctggaaagatggccggatcgtgctggaggatggcagtccgctgatcttttatcatttcagcggataccgaatcgtcagcatcaatgaaatcaaacagattcatgaaacaacccgcacagatctgccgtttgtgcatgaactgtatcaagagacactgccgcatatcattcagcacatgaaaacgttagaccctgaatttaacggttttgcttcaaaagatgacaacaaataaatgagtaaatacaggaagtgaaaatgaagtgaaagcaagcgttattattcctgcatataattcaaaggagcgtctttacaacagccttctgtcattaaaccagcaggagtgcgatgaagaattcgaagtcattgtagcggacaatggctctgaggacgggacgctctcgatgcttgagtcatttcaagctgattttccgctgatctttacacggattaaagaaaacaggggcattgcgtacggacgaaatcaggcgcttcgcaatgccagaggagacatcctgattttccatgacagcgatatgcttgcggcaaaggaccttgtggcaaaacatattaaagcccatgagaacgaagagaatctcgtcgtgtgcgggttgttttggaaacggatctacagtttttactatgaacggtttgaagaagaacataaggaacagctcgcaaagctcacaggtgaaatgccgaagaaagacaaacaaaagctgctggaggaagcggacatcaaaaacggaagctttcttgataaaagctttgacctcgataccgactttatagacgtgctcaagaagattttagatgagtacggcgatgacttgaaagggtatcatatgccatggcgcttttttatcacgaataattcctctgtgaaacgcaagcatgtggttgacctcggtttatttgacgaaggcattgtgcggtacgggtttgaggattatgacctcgggatcaggcttcatcaggccggattgaccttcaggcttcgccgtgatattgtcagtgttcatcaggaacatccaagcaattgtaagtctgtagacgatattcgggcaaacattgcctatatgtgcgataaatacaataacatccgctccttagacgttcatctcgcttttaatgggccgttcccgcctgacatgacgaacagaatcatggctgatattcaaaagctgctggaatcacagaaatatgatatgctgctgaatctgtttcttgagcttctgcatgttgttaaagagcgcaacattgatccggattggcgaaagaaatccccaagggtgacggcgaaaagctttgatttacaaactgtccgcaagcttctgcctaaggcgaagaaaaagctaggcgtgaacgattttgccaacgcactgtatgcgcttgtcaacgatttgctgcacgtggatcttagatcattggatgtggtataagtgagtacatttcatttttcaacgatagtgtcaaggacacatatctttaagctcatgcctatgattcattctctccatgagcattgcgatgattttcatttatatgtgctgtgtgtcgaccagaaagcgtatgaattgcttcagcacgtgccatgggagcatgtaacctttgtgcagctgcatgaaatggaagacccggagctgctgaaagcgaaaagcaacagaacgtttcatgaatattgctggacgttaaagcccgcctttttgtttcatgtgatgagcaagtgggatgacgctgaatactttgcccatatggatacggatctatttttcttttctgatccggcacgtatttttgcagaaaacccaacggcgtctctgtatttgactgatcatcgtaattcgccgcgcttcatgtcctactacgaccgaaccggacgctttaatacaggctttgtcggcgccggtaatacaaaggaagcatatgaagcggtgtggcagtggagacaggactgtattgaattttgcacggtcgaaatggatacggaacgaaagacatatggtgatcaaagatatgtggagaaatggccggagcagtttaaaggtgttcatgttgtcaaatccataggagccaatacagcgctttggaatatcgaaaactataaggtcgggcaaaaggacggccgcgtgtatatagatgaaacgccgctgattttctatcatttctctgggtttacgctggtgacagaaaaagagtttaatctttgctggtactaccggattgaagacgaagcgacaattaagatgatttatatgccctatatattaaatctgaaaagatggattgatgaaatacagtcggcgtttccggactttgcggatggctttatcccgaagcacgcagtgcctgacactcattttatccagctggattaaaaaaccccctgccgcctggcaggggttttttcagctatgccattctctcagcttctggtcacttggcaataggaaggcaaggatgccgaggacagggagaaaggcaatggcgatcatcgtcggggtcagtcccgcggcatcaatcagagcgcccagcgccacagcgccgattgcgcccatcccgaaggcaagcccgacggttaaaccggacattgtgccgatttttccaggaactagctcctgtgcgtagacgaccgttacagaaaagctcgacatcagaaccaagccaatcaatgcgagcacgccgtaggcgagaaccgggccggcaaatggcagcacaatcgccagcggcgccgagcataacagcgaaccgaggataacgaagcgttttccaaaacggtctgcaagcgggccgccgagaaacgtgccgatcgcgccgaacagcaagaagacaaaaatatagctttgtgcctgctgaatgcttacgtgataggtatccatcgcgtaaaacgtgtaaaagttaccgatcgcactcgtataccaagaacgagcaaaaatgagaaatataataataataagagcagatacaacagatttggtgatggccgtgttttcagccgttttcttttgcttgcctgatttctgggcaaggctgccgagacgtgaggcgtaccatttcgcaatatacatgagaaacataacagcaagcgcggcgacaagcgtgaaccaaacagcgccgaattgcccgagcggcacaaggatcagcgcggtgatcagcggtgccatcgcctggcctgagtttccgcccacctgataaatcgattgggcgagcccgcgttttgtgccggcggccatatacgccacacgggagccctccggatggaaaatggccgagcctaatccaatgaaaaacacacagcataagatcgttatgaatgacggggcaaatgcaaggcccaaaatgccaagcatgctggcggtcaaaccgactggcagcgcatacggccgcggccgtttatcggtataccagccgacaacaggctgcatgacggatgacaccatgtttaatgtgaaagcaatgatgccgagctgtgtaaacgtcaggctcatggagcgttccaaaatagggaacatggccggaatcacagcctgaagcgaatcgttgagcatatggcaaattccgataataatcaaaatcggatacaccgtggtgcctggtttttgaactgttttttcttttaacggggcggcgatagccattgagtctcctccttacatatataaccaaagcataccaccatattattcataaggtgaagaatttatcaagaggaaaaaagattcttatgaaagaaataccgtcagcctgattagcagctgacggtattttcgatattcaaaatgtgatatagctcttcaagcttacgaatctcataggttggtatgatctctggcacattcggcttcatgtcagggttcatccagcaagtatcaagcccggcgagctgtccgcctttgatatcagcagttagtgaatccccgatgattaatgtgtgctctgctgaaaattgaggaatccgttcaaacacgtaattgaaatattccttcatcggcttttggaagccggtgtcttcagaaacgaaaatgtccttgaagaatggaaataatcctgaatcacggagacgcttatattgtgtgtgagacacgccgtttgtcacgatgtacaaatcaaactgttgctgcagatttgagatgagatcaaatgcaccgtcaataagctgatgtccttcttcaagaaagcggcggtatttttgctcaagcaaagcgccgtccgcttcgtaaccgtactccttgagcaaagcggaaaaacgtgtgtttacgacttcatcccgtgtcatcttaccttcttcaaaggctctccagagaccttgattgatggttttatactgcgccttcatgtcatttgttaaaggaatgttctgatcttcaaacagcaaacgcagggctaaagcttctgccgcttgaaaatcaaggatggtatcatctacatcaaataataaagtgcggtatcgcttcatctgtgtgtctccctttctcatatgtattcaaagtatagcacataaaaaaaggaaaaagccggcgggtgaggcaccgccggctgaaaagagattatttgtttaataagctgtgttttctcgaatataggaagtaaaccagcgttccgacagcgatccagatgacaaatgaaagccatgtgacgccgggaaggctgtacatgaaccaaaggcagatgcctgcgctgataatcggcacaaccggaacgaatggcactctgaaggacgctttgatttcaggatgtttctttcttaacacaatgacagcaatggaaatgaccgtaaacgcggcaagtgttcccatgttcaccagatgggccagcgttccgaggttaataaagccggcgattcccgctgcaacgatccctgtcagccatgtgttgcggaacggggttttaaatgacggatgaacctttgcgaacaatccaggcagaaggccgtctctgctcatggcaaatgtcaagcggacctgtgcgtacagcaaagcgagcatcaccgtcgtaatcccgataatcgcaccgacagaaataattccggcaacagcgtcctgtccgacgaatttcagcgcaaaggatacaggatctccgacattcaatttggcataaggcatcatgcctgtcagcacaagcgataccgcgatgtacagaaccgtacagacggctagagctgaaataatgccgacgggcatgtttttttgcggatttttcacttcctctgatgcgttagaaaccgcgtcaaacccaaggtacgcgaagaatacagtggcagcgctaagtatgacgcctttcatcccgaatggcataaaaggagaccagttatccggtttcacatagccgatgccgacaataatgaacaataatatgatcgcgattttcatcagtacgatgacgttgttaaagcgtgtgctttccttgacgcctctgctgacaatcgcagtgatgaggagaatgatcaccgcagccggaaggttaaatacggcgcccgccgtgcttcccggcgctcctgtcagtgcagccggaatatgaagattgaagccggcaagcagtgattgaaagtatgaagaccagccggtggcaaccgccgacagtgcaatgacatattcaagcatgagatcccatccgatcaaaaaggcgagcagctctccaagtgtcacgtatgagtaggagtacacgcttcccgaaatcggaatggaagacgaaaactcagcataacagaaagcagccagcgcacaggcgagccccgctaaaataaacgatatgatgagggcgggacctgcaccggtcgctgccactgttcctgtaatgacaaaaatccctgtaccgatgacacaaccgataccgagcaaggttaaatcaaatgcgcttaacgtacgggcaaggctttttgacttgctctgcgcactcaatgtttcaagcggtttttttctaaataatgaactcatcaaaagttcctcctgtaaatattcaaaatattctaatcattatatacagttcttgttgtattatattgtcgaaatttgacgcagtcaataaaatatttttctgctttaaatgatagaagcgaaacagcgttgtcgtatcataggatagtaatttttactaatcgtatattcaattttatgcaagatgaaccgatagaaaaaatagattcgcccatattttgatttgcggttataaaggagatgctgaccatgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaatccgtttgagaaaagaaccattttagaaaaagccgtcacgtatattgaagaaaatgaagaagccattatttatttgattatggaggagctaggcggtacaaggctcaaagcggcttttgaaataggacttgtcaaaaacatcatgaaagaagcggcaacgttcccaatccgcatggaggggaaaattcttccgtccacaatagatggcaaggaaaacagattatatcgcgtgccggcaggcgttgtcggtgtcatcagcccgtttaacttcccattctttttatctatgaaatcagtggcgcctgcactcggagccggcaatggcgttgtgctaaagccgcatgaggaaacgccgatttgcggcggaacattgatcgcgaaaatttttgagaacgcgggaattccagcggggctgctgaatgttgttgtcacagacattgcagaaatcggagacagctttgttgagcatccagtgccgcggatcatctcatttaccggttctacgaaagtcggcagctacatcggacagcttgcgatgaagcattttaaaaagccgcttcttgagcttggcggaaacagcgccttcatcgtacttgaggatgcagatatagaatatgcggtcaatgcggcggtgttcagccgatttacacatcaaggacagatttgcatgtcagccaaccgcgtgcttgttcattcttctatttatgacaagttccttgagctgtaccaggcaaaagtggaatcgctgaaagtcggcgacccaatggatcctgatacgattatcgggccattaatcaacagcagacagacggacgggctgatgaagactgttgagcaagcaattgaagaaggcgctgtaccagtgaagcttggcggatttaacgggacgatcgtggaacctacgatcttaaaagacgtcaaaccgttcatgagcattgccaaggaagagctgttcggaccagtcgtctcctttatgaagtttgattcagaagacgaagcggtggatatcgcaaacgaaaccccgtttggcttgagcggtgccgtacatacgtcaaatcttgagcgcggcgtggcttttgcgaaacgcattgaaacaggcatgattcacgtcaatgacacgaccatcaatgatgaaccgaatgtagccttcggcggtgaaaagcaatcaggcctcggccgtttaaacggtgagtggagcctcgaagaatttacaacgctgaaatggatctcggtccagcacgaaaaacgcagcttcccttattaatgaaaaggagtgaatggaattgaccataaatacggaaaaagaaaccgcagatattctggacgcatttatcaaagtagccccttatttaaacagcctggttcaggatgatattacaatcggcatttatgatacggaaaaactgctcgtgaatataccggccaaaaccttttcgctgaacgtaaaagccggcgatccgctgcaggaaggggatatcatcacagatgccatccgaagcaatcagaagaagacgagcatggttccgaaagaattgttcggcttcccattgatcgcgcgtgccatcccgctgcacgacgagaatggaagagtcattggaggcgtcggcctcggaacgagccttgaggagtcgtcaaagctgcatgatgtcgcggaaagcttatcagctgtcgttgaacaaacagccgcggctatttccgacatttctgaatcaattaacgggttttcaactcaaatgtcgggcatttcctctcaggcgaaaaaagtaagcgaaagcgccggtgaaatcgccgatatttcagtaactgttaaaggcatctctgaccaaagcaatctgctcggcttgaacgccgcgatcgaagcggcaagagcaggggagtccggaaaaggcttctctgtcgtcgcagatgagatcagaaagctagcaacgcattcaaaagaaaatgtcggccaaattgaccagattacgaaaaaaatccacagcctgctgaaagggctggaggaatccattgagtcgattaaccagcatacagacggacaagccgttgctgttgaacaaatttccgccacaatgcaggagatttcaggaagcgcacagcatcttgcaaaaatggccgaaaaagcgcttgaggaagagtaagagaccggggacaaatgtccccggtctttttctatcctgcatttccatgaaattcgtctgacgttttactagttttattccagcggctgatttaaaatgtacacatgaacttacgtgaggattgataggaaccatgagcatattaaaagcggaaaatctttataaaacatacggagataaaacattatttgaccatatctcctttcatattgaagagaatgagagaatcggattaatcgggccgaacggaacaggaaaatcaacgctgctgaaagtgattgccggcttggaatctatcgaagaaggagaaatcacgaaatccggaagcgtgcaggtcgaatttcttcatcaagacccggagctgcctgcggggcaaacagtgctggagcatatctattccggtgaatcggctgtgatgaaaaccttgcgtgaatatgaaaaagcgctgtatgaactggggaaagatcccgaaaatgaacagcgccagaaacacctgctggcagcacaagcgaaaatggacgcaaacaatgcatgggatgcaaacaccttggcaaaaaccgtattgtctaagctgggcgtcaacgacgtaacaaaaccggtcaatgagctctcaggcggccagaaaaaacgggtagccattgccaaaaacttaattcagcccgctgatctgctcattttggacgagccgacaaaccatttggataatgaaacgattgagtggcttgaagggtatttaagccaatatcccggcgccgtcatgctggtgacgcacgatagatatttcttaaaccgtgtcaccaaccgcatttatgagcttgaaagaggcagcctctacacgtacaaaggcaactatgaagtgtttttagaaaaacgcgcggaacgggaagcgcaggctgaacaaaaggaaacgaagcggcaaaacctgctgcgccgcgagctggcctggctcagacgaggagcgaaagcccgctcaacaaaacaaaaggcgagaattgaccgggtagagacgcttaaagagcagaaaggccctcagtcatcaggttcactcgatttcgccattggctcgcaccgtctcggaaaacaggttattgaagcggagaacgtcatgatcgcttatgacggccgcatgctcgtcgaccgttttaatgaacttgtcataccaggtgaacggatcgggatcatcgggccgaacggcatcgggaaaacaacgctgttaaatgcccttgccggccgtcatacgccggacggaggcgatattacgatcggacagacggtcagaatcggctactatactcaggatcatagtgaaatgaacggtgagttaaaggtcattgactatataaaagaaacggcggaggtcgtaaaaacggcagatggcgatatgattacagctgaacaaatgctcgagcgtttcctcttcccgcgttcgatgcagcagacgtatatccgcaagctgtccggcggggaaaaacgccgtttatacttgcttcaggttctcatgcaggagccgaatgtcctgtttctcgatgagccgacgaacgatttggatactgaaacattaagcgttcttgaggattatattgaccagttccctggcgtcgtcatcaccgtatcccatgaccgctatttccttgaccgcgtcgtcgaccgtttgattgtatttgaaggaaatggtgtcatttcccgctttcaaggctcctacagcgactatatggaggagtcaaaagcgaaaaaagcggcccaaaaaccggcagctgaggaaaaatcggctgaagccgagccgaagaaaaaacggaaaaagctttcttacaaagaccagctggaatgggacggcatcgaagataaaattgcccagctggaagaaaagcatgagcagctcgaagctgacatcgccgcagcaggcagtgattttggcaaaatccaagagctgatggccgagcaggcgaaaactgcggaagagcttgaggctgcgatggaccgctggacagaattgtccctcatgatcgaagaactggaaagctaaaaagcgtggccgcagcaggccgcgctttttttcacataatggacaaaaacgaaccggcctgcttatgttaggataaaattgtgtgtcagcggcacatggaaaactaacggagatgatgaagtatgacatgggcgatcgtgatgttaattctcatgagtctggtgaaaatcgtattaacctgtcttcctacaggcgtcatagaatggctgctcagcaaatttgaagtgcacgccaagctgagtggcgaaaatgcgagtctctctctagatggaaaacgtctcgagggtacagagaagcagaaagtgattgatcaatttaacgaagctgtcttcctggagaaatattatatctatccaggtgatgaagagcgttatttacatccggaaaacggcggcacgccgctggtgatagatacaaaaaaaggaaaaagagacgtgaagctgttcgtgtaccgctacgacgaccatatcgacgtcgtgaaacagtacaagaagaaagtgatcgcgtatcgagtgctttctgaaagccttcaaaaagagtctctgtcagtggcgggaagtttagcttaaacaggaaagtgaaagacgggtgctgtatgctactcgtcttttttattgttttttaaaaattaacgtttacgttaaggttcaaaaggtgtataatggtaacagaaacggcgaagggggatttaccttggaatggatgaagattgatcaagtggccaaaagaagcggactgacaaagcggaccatccggttttatgaagaaatcggcttgattccggcgccgaaacggacagacggcggcgtaaggctttattcagaggatgatatggaggagcttgagaaagtcatcagcacaaaagaggtgctcggtttttcccttcaggagcttcagcatttcatggaaaccagccgccagctagagttaaacaaagaggggtatttgttgtcactggatcctaaggaacggaaagaaaaactggaggaaattcaggaaaccctgaatcaccagctgagtttgattgatgagaaaatccgcacattccaaagctttaaagaacgcctgcaaggcatgaaaggcaaagcggaacgcgccattcaatcaatcgaatgaaaagtttgttaaacgctatttttgtagcgtttcttttaatggaataaagatggaggttaggtcaaatggataagacaacacaagtgaatcagaaaacgggtttgctcagccagccaaaagcggtatgggctgtcgcgtttgcctgtgtgatttcctttatgggaatcgggctggtcgatccaattcttccggccattgccgcacaactacatgcttcacctagtgaagtatcactcttgtttacaagttatttgcttgtaaccggatttatgatgtttttctcaggagccatttccagccgcatcggcgcgaaatggacattaattctcggacttatttttattattgtgtttgcggggcttggcggcagctcaagctcaatcgctcagttagtcggctatcgcggcggctggggattagggaatgctttgtttatttcaacagcgcttgcggtcatcgttggtgtatcagtcggaggaagcgcccaagcgattattttgtatgaggctgcgctcggtctcgggatttccgtcgggccgcttgcaggcggagagcttggaagcatttcatggcgcgcaccgtttttcggagtatctgtcctgatgtttattgcgttaatcgcgatttctttcatgcttccgaaattgccgaaaccggcgaaacgcgtcggtgtgtttgatgcgatgaaggcgctaaaatataaaggccttttaacaatggcggtatcggcattcttatacaactttggattttttattttgcttgcttattctccgttcgttctggatttagatgaacacggtcttggatatgtcttcttcggctggggccttctgctggcgattacgtcagtctttacggcgccgctcgtgcacaaagcgctgggcacagtgcgttcgctcgtcgttctctttatcgcctttgcggccattctcgttattatggggatctggacagaccatcagactttgattattacatgtatcattgtcgctggtgctgttctcggtatggtgaatacgatcatgacaaccgctgtgatgggttctgcgccggttgaacgttcaatcgcgtcttcagcctacagctcagtccgcttcatcggcggcgcgctcgctccgtggattgcaggaatgctgtcagaacactttactgcaagcacaccatatacagtaggcggaatcgtcgtttttgtcggcatgcttgtccttctcatgggacgtaaacatcttgctggaattaaggcgggacattaataacgaaagacactgcacagatgcagtgtcttttttaagttgctaaatctacttatcataatagtgttatagtatattctcgtttattttaggggactaagaggactattcatcgcgttgagttccctgaagagacaggttgttataaaaattttaaaattgcatttctcgaacattagtttatgagaggatctttgatcttttaaaagctctttttctttcataatacaatgtcttatgtcctgtttagagctaactagtaaggtcatcatcttatgattatcctattagcagcacttttatgacgcatcttctgttaatactaattggtatcagaaggttgtataatattaactttatgtccttaatatgatatactacaaaaaaacatacgaggtgcgttttgtcagatggaaacgaatccaaaaacagttcagcaagatgatgataaattttttggctttgttttagcagcagttagtatccttgtgggttgtgttttatatttttcttgggatacttttggtaatgaaaccgcaatgaaactgctatcgatgatatttttggtatttgtggcctaggagtcgaattaagtaaagtaacccttaacgatggtgcgttagagatgtgtatagggttggggtttacgttaataccaataatcctaaaagatatttttattagtttcccaaatcttttggctttatttattattgcatttgggtttctttttatcgggaaatctgctcttcgcctatacaaacctaaacctgataaaccaaaaccaaagcttatatttcgtattatgatagcaacaggacagtttctcgggttcattgttaatgtaaataattttgtaaagatgtttttttgaatgataatcttaaaatgaaagtttgaattcacatctccattgcatctcattttaaaagacagagagcttttgagaatcgttcagaaaaaatggcagtaaaaaacccgccctttagcaggcgggtttttttataaattaaagcactttcgtcgtccaagactcgcagttccacgtttctgtcgcgatatccatataaaaatctggctcgtgggaaatgagcagaatggagcctttatattctttcagggcgcgcttgagctcttccttggcatcgacatccaagtggtttgtcggctcatcgagcaccagcaggtttgtttctgagttgattagcttgcacaatctgactttcgctttttcgcctccgcttaatacggagacgcggctttcgatatgctttgtcgtcagtccgcattttgccagagcggcccggatttcatactgcgtataagaagggaattcgctccatacttcttcgatgcacgtattgttgtttgtttccttgacctcttgctcgaaatagccggtatagatgtactcaccgcgttcaacagagccttcgagcggctggatttcgccaagcaaacttttcagcaatgtcgtttttccgatcccgtttgcgccgtaaagggcgattttttggccgcgctccatgcggaggttgagcggacgggacagcggggaatcgtaaccgatcacgagatccttcgtttcaaaaatcagcttgcctgacgttctcgccggcttgaagtggaattccggctttggcttttctgccgcaagctcgatcatatccatcttatcgagtttcttttggcgggacatcgccatgtttctcgtgctgacgcgcgctttgttgcgggcgacgaaatctttcagctctgcgacttcctgctgctgctttttataggccgcttcaagctgctgtttcttcacctcgtagacttccataaactgatggtagtcgccgacatagcgtgtcagctcttgattttcaacgtgataaatcaggttgatgacactattcaagaacggaatatcgtgggaaatcaggatgaacgcgttctcgtattcctgcaggtagcgtttcagccattcaatatgctgttcatcaagatagttggtcggctcatcgagaagcagaatttccggcttttcaaggagcagcttagcgagaaggacctttgtgcgctgtccgccgctcaaatcggtgacatctcgctctaatccgatatcgctcaaaccgagaccgcgggcgatttcttccaccttggaatcaatgacataaaaatcattgtttgtcagcgcgtcttgaatgacgccgacttcttcaagcagcttctcgagctcgtcgggatctgcttcacccattttgttgtaaatctcgttcatttcctcttccatcgcaaataaataatggaatgcgtctttcaggacgtctcgaatggattttcctttttccagcacagtatgctgatcaaggtatccgacacggacgttttttgaccactcgacttttccctcatcaggttcaagctttccggtaataatattcatgaaggttgattttccttcaccgtttgcgccgatcaagccgacgtgctcgccttttaacaggcggaaggaaacgttattaaaaatggcccggtccccgaagccgtggcttaaatcctttacagataaaatactcatgtttacacctctatcgttatcaaacacgcacaatcggcgtgtaatattcacccttttgattataaaggaggattcggaatgttgaaaggtataggaaagaaaaagaaaaattgcgttccgggcgaggttttgagatactatggaatagatttcaggaattgaggagaacaaaatgacgcaaacttggccatttttacataatgcacaatcatttatacaagagaattggaatgcttccggctttcaaacgccaacccctgttcaagagcaggcagcccagctgatcatggatggaaaggatgtcattgcggaatcgccgacaggcacagggaagacgctggcgtatgcgctgccggtcttggagcggatcaaaccagagcaaaagcatccgcaggcggtgattttagcgccttcccgtgagctggtcatgcagatttttcaggtgattcaggattggaaagcgggctcagagctgcgtgcggcttccttaatcggcggggcgaatgtgaagaagcaggtcgaaaagctgaagaaacatccgcatatcatcgtcggcacgccaggcagggtatttgaactgattaaagcaaagaaactcaaaatgcatgaagtgaaaacgattgtacttgatgaagcggatcagcttatcctgccggagcatcgcgagacgatcaaacaaattattaaaacgacattaagagaccgccagcttctatgtttctctgccacgcttaaaaaggaaacagaggatgtgctccgcgaattggcgcaagagcctgaggtgttgaaggtgcagcgaagcaaggcggaggcagggaaagtgaaacatcaatacctgatttgcgaccagcgcgacaaagtgaagctgctgcaaaagctgtcaaggcttgaaggcatgcaggcactcgtatttgtgagagacattggcaacctgagtgtatatgcggaaaaactggcatatcaccacgttgaactcggcgttttgcacagtgaagcgaaaaaaatggagcgggcaaaaatcattgccgcattcgaagacggagagtttcctcttttattggcgactgacattgccgcacgcggtttagacattgaaaacctgccatacgtgattcatgctgatattccagatgaagatggctatgtccacagatcaggacgaacaggccgggccggaaaagaaggcaacgtgctgagccttgtgacaaaattggaggaatctaagctgaaaaaaatggcgaagaagcttggtgttgaactgagtgaagctgtgtatgcaggcggaaaactgaagacgaaataaaaagaagggcgaaaagccctttttttgttgtaaaataatagaaaaagtttcgcgcagggggtgggaaggtggtttcaatagacaggtttcaagcagtgaaggagtcagagctgaaaattcttgaacgctggtttgagaatgaggataccagacgaagaatggatgggatgctgccattagatgagtggtatgcacgagtaaataaagataaacacgatactgtcatcatggcgtatgatggacagctgccggcagggatggtcgttattgagttcggggagaagcgggcatatattggattgatcgtcaatcctttgtaccggcttcaagggtacggaaaacggatattgcaaaagctgatgaccgaacctgattttactagcgtgcgggaatgggtggcatgcattgaagaagacaatcgaatcagtttagcttgctttcaagcagcaggattcactttagaagatacggaacctgatgaagatggttttcttacgctgattcttcgcagctgatctcatcgaaacacaaaaggagggcaaaaagccctcccgttttcatcttcattcagctcggatcactgaccttgatcagctgtttccctttattttctcccttaaataaaccgagaaacgcgtcaggaatgttttcgaagccttctgtgatggtttcctcgtaatggagtttaccagccttcagccattcggccagctgttttgctccctcagaaaaacgatcggagtagtcgcttacgataaagccttgcatcagcgacttcgttttaatgagttttgattggacacgagggcccatgtcatctgcttcgctttctgcgttataggaagaaatggcgccgcacaccggaatgcgggcaaattcattgagcaggttcatgaccgcgtctgaaatcggtccgccgacattgtcaaaatacacatcgataccgtcaggacaagcgtcttgaagcgctttttggatatcacccgctgttttgtaattgatggcttcgtcaaattgaagctgctgttttaaatagtcgattttttcatcagaacccgcgataccgacaactcgagcgcctttgattttggcaatttgaccgactgttgaaccgacggctccggcagctccggagacaaccacggtttcgccttccttcgggcgtccgatgtccagcaatccgaagtatgctgttaagccggtcattcccaaaatgccgagataggccgaagcgggagcaaggcttgtatcaatttttcgcaaggcagactcactcacagcggaaaattcctgccagctgagatttccgatgacgatatcgccttttttcagatgattcccgtctgacacaacttcagcgataaccccgccagaaagcgcttcatccaaggcgaacggcttaacatatgacttcgtatcctgcatacggccgcgcatataagggtcaactgatacataaagcgttttgacaagcacttccccttgcttgggttcaggaaccggaatggtttcaaagcgaaagtcttcatgaacaggaataccttgtggacgtcttgctaattgaatttgctgctgagatgctgtcattttcatcctcctatcacttggttgacaccactgtaacatggacaggagaggaaatacaaaaggtaagctggcatacaaaaaaggagagggggctcctctccttttcatttcgcccgtaatttcgggcacagtcccgtcggcaggcacattggcttctggtcgatcgggcttctcatgatgcagcattccaagccgaagacttcacggaaaaatggctgggtgaacacatcttccggtgttccggcattgtagatttttccgtccagcacactgatcagatagtcagcgtattgagcggcttggtttaaatcatggagcaccatgacaacggtgcggccatggtcgcggttcagctttttcagcagttcaagcacttcaatctggtgtgagatgtctaaatacgtggtcggctcatcaagcaaaagcaaatcagtgccttgcgcaagtgccattgaaatccaggctctttgtctttggccgcctgaaagggcatccagcgtccgatccttcagttcaatcatgcccgttgcttccagcgcccactctaccatgtcatgatcctcttgggtatgcttggataacagctttttgtgaggatgtctgccaaaatagcataattcctctaccgtcaatccttcaggggcctgaggagattgtggaagaatggccagtttttttgcgacttcttttgatggctggcggtggatgtcttttccttctagtagcactgtaccgcttttcggggccatcagcctggcgagcgatttgaggattgttgatttaccgcagccattagcgccgatgagcgcagtgatttttccttcttctatctttaagtcgactccgtcaataatcactgtactgtcatatgaaagagtgagctggtctgcagccagttttcccatggtatcctctccctactgtttcctcgcttcgaatttcaataaatataagaaataaggcgcgccgatcacggctgtcagtattccggcaggtatttcaaccggaggcatgatgccgcgccctaacgtatctgcaattaataatataatagcaccaatcaatgccgatgcaggcagtaaatatttagctttttctccggtaagccgtctggcgatatgcggagcaagcaagccgataaaaccgattgagccgacgacggctacacagcttcccgccagcgccaccgcggtgaaaatcaggatgaatctcagccggtttgcgttttctccgagaccctgtgcaagctcatccccgagtgacataagatccagcttcggtatgagtatgcagacgatcggaaaaagaattaaaagccatggcgcaagcagcttgacttcttcccagtttcttccccagaggcttcctgtcagccaaatgagtgcagcattcacgtcgcccggaaacttgaccatcatatattgcattccggcgtggcagaccgcgcctaaagcaatgcctgataaagccagtgaagagggctgaatgctcttttttcgggctatcattaataatagtacagcaataatggcggctccggcaaatgcggagaacggaagcacgtataccggcgactcaggaaagatgagaatcacagccatcgccgcaagtccggagccttttgaaatgccgacaacgtccggggaagcgagcggatttcggatcacaccctgtaaaatcgctccggcagcggcaagccctgcaccggccaaaattgctaatatgatgcggggaaggcgatattgctggatgataaattcaaaggaatgatccagtcccagcagattcgtcactaccgcatcaggtgaaatgtataatgcaccgattcccatgctgatgacggacagaacgatcaaaatcacggccaatatgattatcgccagtaaggggcgtttttgttttctggttgttttcttcatttcaggtttcgccctttccttgccaaatataagaaaaacggcgttccgataatcgcggtgacaatgccgaccggtgattcataaggaaatgcaatccatctggccagaacatctgcgtacaccagcaaaatggcaccgaacagtgccgaaaacggaagcacgtattgataatgttctccgatcagcttgcgaacaatatgcgggacgagcagcccgacaaagccaatcggcccggcgacggctacggaagcgccggaaaggattaaaataatcaaactgatcagaatccggatgccgttcatattttgtccaagcccttttgctgtttcgtctccgagaccgagaacagaaacagaaccggaaaatacgagggcaagcccgatgccaatgacagaaaacggagcgatggttatgacatcctgccagttgctgccgtcgattgcgcctgtcatccagtacagaacatcctcacctgactcatttaaaataatgatggcctgtgtcatagaggagaggaacaaatgcacggccattcctgacagcgccagcttaacaggtgtcattccgccggatgaggcaatcatatacacaatcgcgccgcctgctgccgcacccgcaaaagcgaatataacagatgaatagggcgatgccggcagaatgacgagagaagcaacgacaaaaagcgatgcacccgcattcacaccgaaaatttggggtgaagccagaggatttctggtcatagcctgcatcagcgcccctgctacagctaggctggcgccgacaaaaacgccgattaatgtgcggggaaggcgaagagtagagatgatgagctgttcctttgaaccgtcccatacaaaaagatatttcaatgaatctatgatgccgatgtctgaggctcctactgaaagattcagcccaagcccaaatataaaaataatcagtgcaatgatgaacatcatcagtcttgatgatgagcgccgtttggctgaatgatacaacagtctcacttccttactgcgtctggttgcaaaaacgaagaagcaaggatttcccctcgcttctcatttgtcctatttattatacacttttttaagcacatctttggcgcttgtttcactagacttgatgcctctgaatcttgtccaagtgtcacggtccgcatcatagacttgtccatttttcaccgctttgagatttttccagagcgggttcgttttccactcgtctacaatggttttgccttcgttggctgagatgaacaaaatatcaggatcgattttgctcaattgctcgaggctgacctcttgataggcgttatctgacttcacggcgtgtgtaaagccgagcattttaaagatttctccgtcataggatgatgatgtatgaagctggaaggaatccgctcttgcaacgccgagaacgatgttgcggttttcatctttcggaagttcggcttttagatcgttgatgacttttttgtgctcggcaagcttttcttttccttcatcttctttatttaatgctttagcaatggtcgtaaagctgtcgatcgtttcgtcatatgtcgcttcacggctttttaattcaatcgtcggagcgatttgtttcagctgtttataaatgtttttatggcgctcagcgtcagcgatgattaaatcaggcttcaaggaactgataacctcaagattgggttcgctgcgtgtgcctacagatgtgtaatcaatggagctgccgacaagctttttaatcatatcttttttgttgtcatcggctatgcccaccggcgtaatgccgagattgcgaacggcatccaagaatgaaagctcaagcacaaccacccgcttaggtgtgccgcttactgtcgtttttccttcttcgttatggatcactctggaatccttagactcacttttgccgcttccgttgttattctggcttgatgaacagccagatacaatgaggcaggcgagcaataaaacactcatgatggcaatcaacttgttagaataggtgcgcatgtcattcttccttttttaagatttagtaatgagaatcattatcacatgtaacactataatagcatggcttatcatgtcaatatttttttagtaaagaaagatgcgtttttactgctttctcatgaaagcatcatcagacacaaataagtggtatgcagcgttaccgtgtcttcgagacaaaaacgcatgggcgttggctttagaggtttcgaacatatcagcagtgacataaggaaggagagtgctgagataaccggacaatttcttttctatttcatctgttagtgcaaattcaatgtcgccgatattcatgataatcgagaaaacaaagtcgatatcgatatgaaaatgttcctcggcaaaaaccgcaagctcgtgaattcctggtgaacatccggcacgcttatggaaaatctgtttgactaaatcactcacaatccaagcattgtattgctgttctggtgaaaagtattgcattagacatacctcctgctcgtacggataaaggcagcgtttcatggtcgtgtgctccgtgcagcggcttctctttaattttgatttttctgaaaataggtcccgttcctatcactttaccatggacggaaaacaaatagctactaccattcctcctgtttttctctttaatgttctggaatctgtttcaggtacagacgatcgggtatgaaagaaatatagaaaacatgaaggaggaatatcgacatgaaaccagttgtaaaagagtatacaaatgacgaacagctcatgaaggatgtagaggaattacagaaaatgggtgttgcgaaagaggatgtatacgtcttagctcacgacgatgacagaacggaacgcctggcagacaacacgaacgccaatacgatcggagccaaagaaacaggtttcaagcacgcggtgggaaatatcttcaataaaaaaggagacgagctccgcaataaaattcacgaaatcggtttttctgaagatgaagccgctcaatttgaaaaacgcttagatgaaggaaaagtgcttctctttgtgacagataacgaaaaagtgaaagcttgggcataaagcaaggaaaaaaccaaaaggccaatgtcggccttttggtttttttgcggtctttgcggtgggattttgcagaatgccgcaataggatagcggaacattttcggttctgaatgtccctcaatttgctattatatttttgtgataaattggaataaaatctcacaaaatagaaaatgggggtacatagtggatgaaaaaagtgatgttagctacggctttgtttttaggattgactccagctggcgcgaacgcagctgatttaggccaccagacgttgggatccaatgatggctggggcgcgtactcgaccggcacgacaggcgggtcaaaagcatcgtcctcaaatgtgtataccgtcagcaacagaaaccagcttgtctcggcattagggaaggaaacgaacacaacgccaaaaatcatttatatcaagggaacgattgacatgaacgtagatgacaatctgaagccgcttggtctaaatgactataaagatccggagtatgatttggacaaatatttgaaagcctatgatcctagcacatggggcaaaaaagagccgtcgggaacacaagaagaagcgagagcacgctctcagaaaaaccaaaaagcacgggttatggtggatatccctgcaaacacgacgatcgtcggttcagggactaacgctaaagtcgtgggaggaaacttccaaatcaagagtgataacgtcattattcgcaacattgaattccaggatgcctatgattattttccgcaatgggatccgactgacggaagctcaggaaactggaactcacaatacgacaacatcacgataaacggcggcacacacatctggattgatcactgtacatttaacgacggttcgcgtccggacagcacatcaccgaaatattatggaagaaaatatcagcaccatgacggccaaacggatgcgtccaacggcgctaactatatcacgatgtcctacaactattatcacgatcatgataaaagctccattttcggatcaagtgacagcaaaacctccgatgacggcaaattaaaaattacgctccatcataaccgctataaaaatattgtccagcgcgcgccgagagtccgcttcgggcaagtgcacgtatacaacaactattatgaaggaagcacaagctcttcaagttatcctttcagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagatcaacgcatcggctgcaaacgggctgagctcttctgtcggctggacgccgtctctgcatggatcgattgatgcttctgctaatgtgaaatcaaatgtcataaatcaagcgggtgcgggtaaattaaattaagaaagtgaaaaacacaaagggtgctaacctttgtgttttttaattaattaaaatgtttattaacttagttaaggagtagaatggaaaaggggatcggaaaacaagtatataggaggagacctatttatggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtcgcaacaattatcggctttatctccaagcccttgccaatgggtgcaattgcaatttttgcattggcggttactgcactaactggaacactatcaattgaggatacattaagcggattcgggaataagaccatttggcttatcgttatcgcattctttatttcccggggatttatcaaaaccgggctcggtgcgagaatttcgtatgtattcgttcagaaattcgggaaaaaaacccttggactttcttattcactgctattcagtgatttaatactttcacctgctattccaagtaatacggcgcgtgcaggaggcattatatttcctattatcagatcattatccgaaacattcggatcaagcccggcaaatggaacagagaggaaaatcggtgcattcttattaaaaaccggttttcaggggaatctgatcacatctgctatgttcctgacagcgatggcggcgaacccgctgattgccaagctggcccatgatgtcgcaggggtggacttaacatggacaagctgggcaattgccgcgattgtgccgggacttgtaagcttaatcatcacgccgcttgtgatttacaagctgtatccgccggaaatcaaagaaacaccggatgcggcgaaaatcgcaacagaaaaactgaaagaaatgggaccgttcaaaaaatcagagctttccatggttatcgtgtttcttttggtgcttgtgctgtggatttttggcggcagcttcaacatcgacgcaaccacaaccgcattgatcggtttgtccgttctcttattatcacaagttctgacttgggatgatatcaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgcgacagcccacatcagtgcgatgtattcagcatttttggctgtcgtcgtggcagcgggcgcaccgccgcttttagcagcgctgagcctcgcgttcatcagtaacctgttcgggtcaacgactcactacggttctggagcggctccggtcttcttcggagcaggctacatcccacaaggcaaatggtggtccatcggatttattctgtcgattgttcatatcatcgtatggcttgtgatcggcggattatggtggaaagtactaggaatatggtagaaagaaaaaggcagacgcggtctgccttttttttattttcactccttcgcaagaaaacggattttgaaaaatgagaaaattgcctgtgaaaaatggtatgatctaggtagaaaggacggctggtgctgtggtgaaaaagcggttccatttttccctgcaaacaaaaataatggggctgattgcggctctgctggtctttgtcattggtgtgctgaccattacgttagccgttcagcatacacagggagaacggagacaggcagagcagctggcggttcaaacggcgagaaccatttcctatatgccgccggttaaagagctcattgagagaaaaggcggacatgcggctgagacgcaagaggtcattgaacaaatgaaagaacagactggcgcgtttgccatttatgttttggacgaaaaaggagacattcgcagcgcctctggaaaaagcggattaaagaaactggagcgcagcagagaaattttgtttggtggttcgcatgtttctgaaacaaaagcggatggacgaagagtgatcagaggaagcgcgccgatcataaaagaacagaagggatacagccaagtgatcggcagcgtgtctgttgattttctacaaacggagacagagcaaagcatcaaaaagcatttgagaaatttgagtgtgattgctgtgcttgtactgctgctcggatttattggcgccgccgtgctggcgaaaagcatcagaaaggatacgcttgggcttgagccgcatgagatcgcggctctatatcgtgagagaaacgcaatgcttttcgcgattcgagaagggattattgccaccaatcgtgaaggcgtcgtcaccatgatgaacgtatcggcggccgagatgctgaagctgcccgagcctgtgatccatcttcctatagatgacgtcatgccgggagcagggctgatgtctgtgcttgaacaaggagaaatgctgccgaaccaggaggtaagcgtcaacgatcaagtgtttattatcaatacgaaagtgatgaatcaaggcgggcaggcgtatgggattgtcgtcagcttcagggagaaaacagagctgaagaagctgatcgacacattgacagaggttcgcaaatattcagaggatctcagggcgcagactcatgaattttcaaataagctttatgcgattttagggctgcttgagcttggggagtatgatgaagccattgatctgattaaagaggaatatgcgatgcaaaatgaacagcatgatcttttattccataacatccattcgcagcaggtgcaggccattttgttagggaaaataagcaaggcatcggaaaagaaggtcaagctggtgattgatgagaacagctcactcgcgcctcttcctgcgcatatcggcttgtcccatcttattacgattattggcaatttaattgataacgctttcgaagctgtagcggagcaaagcgtgaaggaagttttgttttttatcacggatatgggccatgacattgtcattgaagtatcagacacagggcccggtgtgccgccagagaaaatagaagctgtgtttgagagaggctattcttcaaaggggatgaggagaggctacggtctggccaatgtgaaagactcagtgcgtgaactgggcggctggatcgaactggcgaatcaaaaaactggcggggcggtattcactgtgtttataccgaaggagaaacaaagggggaatccatttgattcacatcgcgattgcggaggatgattttcgagttgcgcaaatccatgagagattgattaaacagcttgatggattcaagattatcggcaaggcggctaacgcaaaagagacattggcgcttttgaaggaacacaaggttgatttgcttctgctggatatttatatgccggacgagcttgggaccgcgttgattcctaatatacgaagccgatttcctgaagtggacattatgattatcacagcggcaacagaaacccggcatttgcaggaagcgctaagagcaggaattgcccactatttgatcaaacccgtaacggctgacaagttcaggcaggtgttgcttcagtataaagaaaaaaggaagctgctcatgtctcagccggaggtcagccaatccatgatcgaccatatttttgggaacagtgtgaagacagctttgccggcagaggatttgccgactggcattaattcgattacactgcgaaaaattaaggaagcgcttcagactgcgtcagaaggattgacagcggaggaacttggggaaaaaatgggggcgtcacgaacaactgcccgccgttatgccgagtatcttgtgtcaaaggaagaagcaagagccgagcttgaatacgggattatcggcaggccggagagaaaatattatttggcggcggattagatatgaaaaaatctataatcctattgattttactattgatctttatgcagggtgatatcaggcaggcggctgcgccgcgcctgccggacgggccgatagaaattgttgtccctgccgaaccttctggcggctgggatgtcacagcgcaggcgatccaatcagttttgaggcagaagcagatcgtgaagggagatgttcatatcgtctataaatccggcggcgggggagagaaaggctggaaatatgtcaacaaaagcagcaaacaaaccatcagcatgacgtccagcctaatattgagcaatgatcttctcgggcaaagtaaattaaaaatgtccgattttacgccgctcgccattctctccaaggaatggcagacggttgcattgccaaaaggatcagcgttaacaaatggcaaggatgtgctgaatgagatcaacatgcatcccggcaaggtgagaatcggctttgccccggggtttggcaatgatgatcagctctcgttcgtcagagcggcagatatgtacggcattgacccgtttgacattcaattctcacagtatgacagcagcgaacagctcattcaggcgctgatcagacatgagatagaagcggcttccatgacactttctgaagcgaaaccatatgaacgaaacggcgatatcacgttagccgctgtaacgtctgataaaagacttcccggttttccaaatgtaccgacgtggaaggagcagggaatcccgtttgttttttctcattggagagggattttgggcccgaaaaatatgtctgaggaagagatttcttactgggatcaagcgctaaagaaggtcacctcctcacctgaatggaagcggaaaataaacgaacaggactgggaaagcttttatttgaacagcagggaaacgaaacggtttttagaagagcaatctgctttttatcaaagcatcatgacaggaaattaagatcccggcatcccgggatttttttcatgccgaaaattgatcaaaaagaacaaaacggttttaaaaaattaaaaatacaaaaaaaccaaattatttacttgcggttggttttcccatacgatggcaaaaaggcaagacaaaaaggggagtaagggagaaaaaaatgtaagcggattcatttaagggggaatggatgtgttagcaatcttaggctttctcatgatgcttgtgtttatggcattgatcatgacaaaacggctttctgttttaacagcattagttttgacgccgattgtgtttgcgcttatcgccggatttggatttactgaagttggggacatgatgatttcggggattcagcaagtcgcgccgactgcggtcatgattatgtttgcgatcttatattttggaattatgattgatacaggcctgtttgatccaatggttggcaaaattttaagcatggtcaaaggagaccctttaaaaattgttgtcgggacagcggttcttacaatgctcgtcgccttggacggagatggctcgacaacgtacatgattacgacaagcgccatgcttccgctctatttgctgctaggcatccggccaattatcctggcgggaatcgcgggagtcggcatgggaatcatgaacacaattccatggggcggtgcgacgccgagggcggcgagtgcgctgggggttgatccagctgagcttacagggccgatgattcctgtcattgcaagcgggatgctttgtatggtggcggttgcgtatgtgcttggaaaagcggaacgaaagcgccttggtgtgattgaactgaaacagccagccaatgccaatgaaccggcggcagcggttgaagatgagtggaagcggccgaagctttggtggttcaatttattgttaacgctttctttaataggatgtttagtatcgggtaaagttagtttaaccgtactgtttgtcattgcgttttgtattgcgctgattgtgaattatcccaatctcgagcatcagagacagcgcatcgcagcgcattccagcaacgtgctggctatcggttcaatgatttttgccgcgggggtgttcacggggattttgacaggcacgaaaatggttgatgaaatggcgatctcactcgtgtccatgataccggaacaaatgggcggattgatcccagcgattgtggccttaacaagcggtattttcacatttttgatgccgaatgacgcgtatttctacggggtgctgccgattttatcagaaacagctgtcgcatacggtgtggataaagtggaaattgccagagcctctattatcggccagccgattcatatgctgagtccgcttgtgccatccactcatttgcttgtcggactcgtcggagtttctattgatgaccatcaaaaattcgcattgaaatgggcggttctcgcagtgatcgtcatgacggctatcgctctattgatcggtgcgatctctatttccgtatgataattcaggcgtaatgacacacactaacggcatacaacattccggaggtgtcattatgagtgatccttatatgccgctgacttcaatcagaagcggaacggggttcgaagcggcaaaaggggtgcacggcctgactgtgcaaattgcgaatgtctattttattcagatgccttctgaacctcactcatttgttttaattgatgccggcatgcctcaatcagccggcatgattgtcaatgaagccaaacaaagattcggtgaagggtttcagctgaaggcgattatcttcacacacgggcactttgaccatattggggcaatcgaagagatccttgaacattgggatgtacctgtttatgtccattctcgggaaatgccctatgtaacaggtaaagaggattatcctccggctcgtcctgacagcaagagcgggctggtcgccaagctgtcgccgctgtttccgcggcactccatcgatatttcctcacatgtccaggcactgccggaagacggttcagttccttttcttgacgagtggatgtggatcgcgacaccaggacacacgccgggccatatttcgttattccgcgatgacggccgcgtgcttgtggcaggtgatgctgttattacagtggaacaggagaaaatggctgacgtcttgatacaaaaacaggagcttcacgggccgccggcttatttcacgcctgacacagagacggccgcggagtccattctaaagctggccggtcttgaaccggaagcgttattgacagggcacggcataccgatgaccggcaaaaactttcgaagtgacttaactgaattggcaaatcggttatcgtctatttgacacccgcaccacgcgggtgttttttattgttttccaggaagttgcagaaaaatcatttgtcttgccgcttaaaaacgatacaatgaaaagcatgaagtgatgtgaaggggagagtttgttggaagaaaaagaaatactctggaacgaagcgaaagcgtttattgccgcatgctatcaggaattgggaaaggaggaggaagtgaaagaccgtctcgaggacattaaaagcgaaattgacctgaccggaagctatgtacatacgaaggaagagctggagcacggagcgaaaatggcttggagaaacagcaaccgctgcatcggcagattgttctggaattcgctgaatgttatcgacagacgagacgtccggacgaaggaggaagtgcgtgacgccctctttcaccatattgaaaccgccaccaataacgggaaaatcagaccgaccattacgattttccctccggaagagaagggtgaaaagcaagtcgagatctggaatcatcagctgatccggtacgctggatatgagtcagacggagaaagaatcggcgacccggcttcctgttccctgacagcagcctgcgaagagctcggctggcggggagagcgaacggattttgacctgctgccgctcatttttcgcatgaaaggggacgaacagcctgtctggtatgagctgccgcgttcacttgtgatcgaggttccaatcacacatcccgacatcgaggcgttttctgatttggagctgaagtggtacggcgtgcctattatttctgatatgaagcttgaggtcgggggcattcattataatgccgcgccatttaacggctggtatatgggcacggagatcggagcgagaaacctcgcagatgaaaagcggtacgacaagctgaaaaaagtagcgtccgtgatcggcatcgccgctgattacaatacggatttatggaaggatcaagcgctagttgaattgaataaagcagtgctgcactcgtataaaaagcagggtgtcagcatcgttgaccatcatacagcggcaagccagtttaaacggtttgaagaacaggaggaagaagcgggcagaaagctgacgggggactggacgtggctgattccgccaatttcacccgctgccactcatatcttccaccgatcctatgataactcaatcgttaagccgaattacttttatcaagataagccttatgagtaaacaatagaaaatcgatgatggccttcaaggctgcgggattcagtcacagagatgtcggtaacctttgagaaagggcttccgttctttacagcctcaacaaacgattgcagggcgttttccggaccctctgccaaaatctcgacacgcccgtcatcacggtttttgacccagccggccagttttcgcttatcagcttccatttgaacaaaatagcgaaagcccacaccttgaacccggccgtttacaatgattcggtattgaagcatgtaaaaaccaccttttctttttatgataatcaatcattttacaacctgtaaaggggatgtgtttgtatgaaaccagagtgctattcagttctttctcttaatctgggaaaaccgcagacgcttgaatatgacggaaagaaaatcgaaaccggcatcatgaagcggccggctgaatcagccgtcatgctgtatcgggagaattttgaaggagacggacaggcggacctcgtcaaccacggcggacctgataaggctgtctgtgtctacccggcggagcattatccgttttgggaagagttcctctcaagaccgctgtcaaatgccgcatttggagaaaatttgacggtcgcgggcctgactgaggagaatgtttgcatcggggatgtgttcaggcttgatgaagctgttgttcaggtcagccagccgcgccagccgtgtgtaaagctggcgaaaaagtttggtgtaaaagaaatggtgctgaaggtccagcaaaccggctatacagggttttattttcgcgtgctggaggagggcagggtgtctcccggcgcgaaccttgaattgctgtccagaggagagaagggcatatccgtccagttcgccaaccgcatcaactaccatgatgcaaaaaatctcaccgccatagaactgattttaagtgaggctgcactatcggaaagctggagagcgtcctttatgaaaaaaaaggacaggctgctgccggttgaatagaaaaaagccgcgcatatcaacgtgcgcggctttgccatatttaagattgttttttctttgattcaagcaggttggcaagaaaataggttttatagctttgaagctttcttccttcatggtgcgtgatcccctgcttttttagttctgccacataccagcctttactgccgtaatgcatgtcagaaaactcctttccctatctgatttcgaaacgattggcattgtaacatctataaaaagatgctgaaaagagatgcggggaaaactgagcctttcgaactagatgtacgaatgttcttctgtatgtatatgcggagcaaaagccgaatatgatttaatggccggttagtttgatcatgacaacgccaaatgtcataatggcgaaaacaatgccgatatatgtgagcatcccgttttttttcttaacgccgtaaacggttataatgatgccttcaatgaaaaaaatgatgccgaaaataataaaccacatgcagataaaggctcctttcacagacataatagtagtgtagcatatctgaaagagccgggctgtgacaatatcaagaaagccgggcgcatatcgcccggctcatgttttattgtttatcaaccaatttgaccagaagctgtgccaaatgttctttctcatcttcgtctgcaacgctccaaagctcttgcagcagcatttcttcaccgttttgcggctcttcatgctttgcgaggtagtctcccaagatcgcagcgctttttacaagcttgccgtcatccaatcccagctttttgcctcggttgacttgttttttcaggtagcctttaaattcatcaaagtcttttaaaatgtcttcttttattgtgccatgcatcgcgttcatttcgttttcaatttggattttttcttgatctctgttcattgcaagacctcctcgtgcagaataatgatgttttacctgctattggaggaggttaaacctgccggaagcccggaatgtgttttacagtttcgtcaggataatcggttcatcttttgtgatgacgatcgtgtgttcaacttgggcaaccatgcttttatccggcgtcttgaacgtccagccgtctccagcttcaacaatcgtttctgctttcgttgaaataaacggttcaagcgcgatgactgtgccatttttgaacagcgcattatcaaacggatcataatagttcatgatgtggttcggcgcttcatgcaggcttcggccgattccgtggccggtcagggttttgatgacggtaaagccttgagagcgtgcttcatgataaacggctcttccgatctggttttggcgcttgcccgcttttgcctgctgaagccccttttgaaaagcgtcttccgcgcattggcaaagcttatgaaggcgttcttctccttcaccgagcacaaatgagatgcctgtgtcggaatagaacccgccaaattcagcggagatgtcgatgttgacaaggtcccctgcttttaaaatcttggaagtgctcggtatgccgtgagccacttcatcatttacgctgatgcatgtcacacctggaaaatcgtattccttctcaggagctgaaacggcgccatgctcatcaagcacagcttttccgataaggtcaaggtcttttgtgctcatgccgggctctgccttccgcttcatttcttcacgcgcaagcgcgacgattcttccgatttttttcaggccttctaattcttgatcgtttgttacaatcatctgtcattcccgctttctttttaaataatctagattaagcttaccacaactgtcttaaaaataggaaacacacggacctgggaaaaaagaaatacccccgggaaaattggtatagatcactagatatcttatatggtatatttgaaaaaaaagggtatgagggggatgggtatgctttcatttttacaaaaactcgggaagtcatttatgctcccgattgcggttctgcctgcggttggaattatccttgcgcttggcagagaggatgtatttaatatcccgtttgtctatcaggcggggacggcggtttttgatcatctgccgcttatttttgcgatcggtattgccatcggcatttcaaaagacagcaatggggcagcgggtttatcaggggcgatatcgtatctgatgcttgacgcggcaacaaagacaattgataaaacaaataacatggcggtgtttgggggaattattgccggtttaattgccggttacacctataaccgcttcaaggataccaagctgcctgaatatctcgggttcttcagtggcagacggcttgtgccgattttaacagccattattacgatcattttagcgggcatattcggagtggtctggccgccgattcaatcgtgtatcaactcgtttggagagtggatgctcgggctcggcggcatcggggcaggcatattcggcctattcaacaggctgttaattccgcttggccttcaccatgtgctgaacaatattttctggttccaattcggagaatataacggagtgacaggggatttggcgcgctttttcgcgaaagatccgactgcgggcacatatatgaccggatttttcccaatcatgatgttcggtcttccggcggcgtgtctggctatggttgtgactgcgaagccgtctaaacggaaagcgacggctggaatgatgattggatttgctttaacggcgtttatcacagggattacggagccgattgagtttgcatttatgtttttatctccgcttttatacgctgttcacgcggtcttaaccgggttatctttatttatcgtcaactggctcggcatccgctcaggcttctctttttcagccggagctatcgattatgtgctcagctatggaatcgcggaaaaaccgctgcttctgcttttggtaggtatatgctatgcggcagtatactttatcgtgttttatgtactgattaaggctttgaatttaaaaacgcctggacgggaagacgatgatgtggatgaagtgctggatgaaaatactgttcaggatgtaaatgaaaacatcatgctgaaagggctcggcggaaaagaaaaccttcaaaccattgatcattgcgccacaaggctgcgactgactgtgaaggataccgctttggtggatgaagcgctgctaaagaaagcaggcgcaaaaggggttgtcaaatcgggcgggcaatcggttcaagtcattattggcccgaatgtggaatttgcagctgaggaattgagggctgctgtcaaataaaaaagcggagagggcaacctctccgctttttcttatttatcttcgttatcctttgacgtttcggaagaatcttcgtcatgttttgtgtaatcataatcagaaggattcaccttcttaaaacctttcggctcgtagaaccgcagcaggtctccgtttatgattttatcggacatttcaagttccttcttgacgagcgagtcttctgacttgtcgacttcggattcatcgagttcttttccggttttcgtgtcgtaatacttaccggatattttcgtgtacttcggtgaaataaagtctccgtttcggaacggaatcacttcacggtgttctttcgataaaatatcagacccggacatcagatagtccttcgtatccactccgagcagatgcagaatggtaggagccacatcaacgtctccggcatatttatgaactttctcgcccttcacgccggcagcgtggataaagagcggcacccgttgaagctgggcgttgtcgtaatcagtgatttcatccttgccaagcactttcgccatcgctttattgtggttttcagagatgccgtagtggtctccgtacatcacaataatcgatttatcatataacccgtcttttttcagatcattgaagaattgttcaatggactgatcaaggtaatgggctgactggaagtagttatcgacgacagagtcaccaaagtctccagccgggaagtctgtatccccctcatccattccgaatgggaagtggttagacagggtaatgaacttcgtatagaacggctgcggcaggctttccagcagcggcattgattctttgaagaacggtttgtctttcatgccgtagtttttcgtgttttcttcgttcatgtcatagtaagcagaatcaaagaatttatcaatgccttccgctttgtacatttcgttacggttccagaacgtctgcgtgttcccgtggaaagtagcagatgtgtaattcttagacttcagaatcgccggaacggattgcagcgtgttttgtgctttgtttacgaaaactgaaccttgagccagcgggtacagagagttttccatcataaattcagcatcagatgttttaccttgtcccgtttggtggaaaaagttatcaaagtagaacgtttcgttatcatgtgccagtttatttaagaacggtgtcacttctttgccgtcaattttatagtcgataataaatgactgcaaagattcaagtgaaacgtaaatgacgttttttccttccgctttgccgaaatacacgttattcggcacatcgtaattggctttcatgtagttttccacttccgtcacgtcgctggaatcggcaagcgcgcgctggctgttggacttgatattctgtacagcgtcataaatcgtgaaattgtatgttcccaagtatttcacaagatagttccggtcgaatgatcttgtcagcaattcaggacggtctgattccgcaactgccaggttgatcaagaacacaagaattgaagacgcaaaaataattcggaacgattttttgcttgacgtttcggcaggcttgtttactttgatcgccaagatgatcaggatgatcgtatcgataaagtaaaaggcgtcagtcggtctcatcagcgaaaatgcgctgtcaccgagttggccgccgtttgttttagcctgcataatgaccggaattgtaataaaatcattgaaaaatctgtagtacacaatgtttgcgtacagtaaaaaagacattaaaaaatgaatcactataatggctgtctgctgtaattttttcttgaacaagagtccaaagccaagaaagaacaagcttgagctaagaggattcacaaaaagcaatattttttgtatcgtgttgtctattcctaagttgaagttcaggacataaccgacatacgttttgatccataacaggacgaccgcaattaagaagaaggccagtcctctttcttttataaatgttttcattgttacactccttttttccgatccagttcgagcgaaacgatagaaaaaacgaacgtatccaatataacacgaatcagcagattagaaaagtgaaaatcgtatgatggagaaagtggcgaaaaacgccgtcgaatcaacgtttcgctttgatattaccaaatgtaaaacaaggtatctttctagaaataaaggaataaaatggtacattgagaattgtatgataaaatataaggtatagataaaaagaggtgaaatgatggatttttcccatattgtgtctgaagataaaattaagcgcgccatcaaagacggggactttcaaaacctcccgggaatggggaagccgctgccgaaggatgacgcggcacacttgccggaatcgctgcgcatgggctatcgtattttgaaaaacgcgggaatggcagaggacgagggcgcgctcaaaaaagagcttatgaccatcgaccatttaattgaaaagtgctatgacgaaaaagaacgcgagcaattaatcagaaaaaaatctgaaaagcaattgctgcttgataagcttgtcgacaaaaaaggcatgttttcaaagccagcatccgctttttataagaataaagtatatgaccggcttggacgaaacagaccttcttccagctgatttgtcttgtctgcaggatggcgattgataaaagccatcctttttatgttccaagttctatgtcaaaaggtttatgtttttccatctatgggaaatgattcataaacgaaaaaagggtgatgggatggaacgactattagtatggatagagcatatatctgattggctgtggggtccgccgctaatcatcctgctgacggggacggggttgtatttcactattttgctgaaaggttttcaatttcgctatcctttatacattttcaaacagacaatcggcagcgtaggaaaaaaaccgaagggagagggcacagtcacaccgcttcaggcattgacctcagccctcagttcaacgatcggtgcagcgaacattgtcggtgtgcccgccgctattatgtttggaggaccaggagcggttttttggatgtggctgattgccttatttgccatggcgattaagttttctgaaagtgttcttgctgttcattacagagaaaaaaatgagcagggtgaatacgtcgggggaccgatgtattacataacaaaagggctgcgcatgaaatggctcggcgtattcttctctgttgcgctgattgtggagctgatccccagcattatggttcagggaaattcggtttcagtctcgcttgctgagacgttttctttcaataaaatatacgcaggaatcggaattgcgtttttgattgggttagtggtgataggaggggtaaagcggatcggaaaagtaacagagtttgtcgtgcctcttatggcaggggcatacgcaggtgccggtctcctaattgttctcatgaatctatcatcagtgccggcgtttttctctctcgttttttcaaatgcgtttacctcttcttcagcagttggagggttcgcaggtgctgcgttggcggaaaccgttcgctggggatttgcccgcgggctttattctaatgaagccggaatgggaacagccccgattgcacatgcggcagcaatgactgatcatcctgtgcggcaagggttttggtctgtgatcggcattgtcattgacaccttgatcatctgcacgaccaccgcttttgtcgttcttgcatctggtgtctggacagggaagaacgcctcaattgatccggcagcactgacgacggctgcatttcagcattatttcggttctggcggagggtacttcgtttcggtttccctagtcttctttgtcgtatcaaccattatggttgtcattttttacggcgtaaagcaagctgaatttctgttcgggcggctggcaggacacgtgattaaattcgtttatttagcggctattatcataggtgccgcaggcggagcaaaagccatttggggctttttggacttagcattggcttttattctcgtcccaaatgtgattgcgctgttgttattgagcagaaaggtaaaagcgctgtacaccgaattctttacatctgaacagtactacctgaaagatataagaaaaacaaaacagaatcctgtttatcaaacaaaagaagctaaaaactcctagtgctttgctttggcgccgaacaacgctttgctttttatgatcaaataaatgagtaaaggcagcaaaagagaaatcactacattaatgattggtttgattctgttaaagtcgattagctgatttgtatttaaaaagaaccaaaagctgcatacgactgagaacatgccggttggtgtatacatggctttcgggtcgttttttgagtgtaagagcgataggctgtaccacgatacttcactataatgacggaaatccaaaaggccgtgatgatcaggcctgaacgatccaagatacaatcatcaccatggggcagacacaatttccgcatcagtactgtcccaataacaagagcgccgaggatgccgaccgtctgaccaacggttttcggcaggcgcactcccttttcacggagagcctcagctgtttggcggggaaagaaatcggctagcgggcagacgccgcgctgaacattataccctgaggctttcagtgaagccctctctcgatcctttgatggtcgattctgttattaacttttcaaagtttcttcataaacaataaatccgcacagcccgtttccaaagtcaaattgtctaaatacgatgtctgagcagccttctgttaataaggtcagattatcgaggttttccttcaaattgggagagatcggtctgtcctgattgtcttcaagctctttgatgagctgaagcgctttgtcgcgtttattcatagagactcaccctgctttttaatgtcacaataagtgcttgtgacttttagggtaaccttgtctgtttcatatattccagactaggatgaaagcgctataaaaaagtgttgactacctgtatatacaggaatacaatatgattataagttgtatatacaagttataaaaacggatacggaggggttggcatgggggaactgaacaaatcggcacgtcagattgtcgaagcagtcggcggtgctgaaaatattgcagcggcaactcattgtgttacacgtttgcgttttgctttaatagatgaaagcaaggttgaccaagagatgcttgatcaaattgatgtggtaaagggatcattctcgacaaacggacagtttcaggtcgtaatcggccagggaactgtcaacaaagtatatgctgaactggtcaaggaaacgggaattggcgagtcaacaaaggatgaagtgaaaaaggcctcagaaaaaaatatgaatcctttgcagcgtgctgtgaaaacgcttgcagatatttttattccaatattgcctgcgattgtcacggcgggtcttttaatggggatcaataacattttaacggcggaaggcattttcttcagcacaaaatcgattgtgcaggtttatccgcagtgggcggatcttgctaatatgattaacctgattgcaggcacggcctttacgtttttgcctgcgttaatcggatggtctgccgtcaagcggttcggcggcaatccgcttctcggcattgtgctcggagttatgctcgtgcatcctgatttgctgaatgcgtggggatatggcgcggcagaacaaagcggagagatcccggtatggaatctattcggcctagaggtgcagaaagtcggctatcagggccaggtactcccaattttgcttgcttcttatatgctggcgaagattgaggtatttttaacaaaatgcacacctgagggcatacagctgctcgttgtcgcaccaattacgcttctcttaacaggatttgcctcttttatcattatcggcccgattacatttgcgatcggtaatgtactgacttcagggcttatctcggtgtttggttcttttgccgcactgggcggtctgttatatggcggtttctactcagcgctcgtgattaccggtatgcatcacacgtttcttgcagtcgacctgcagctcatcggttcaaagctcggcggcacctttttatggccgatgctggcgctttctaatatcgcacaaggttcggccgctctagccatgatgtttatcgtgaaggatgagaaacaaaaaggcctctccctcacatcagggatttctgcttatcttggcattacagagcctgccatctttggggtgaatctgcgatacagattcccgtttatcattgcaatggtcagctctggcctggccggaatgtatatttcttctcaaggtgtgctggcaagctccgtcggtgtcggcggcgtgccggggattttctcaatcatgagccagtactggggcgcgtttgcaatcgggatggctattgtattgatcgtgccatttgccggaacatacgcgtatgcgagattcaaacataaataacaaatggggagcgggacgtgttgaacgttcccttttcccgttttcaatttaaatatggtggtggaaacagatgaaaacagaacaaacgccatggtggaaaaaagctgtggtttatcaaatttatccgaaaagctttaacgatacgacaggaaatggtgtcggcgatctgaacggcattattgaaaagcttgattacttaaaaacacttcaggtggatgtgctttggctgacgccgatttatgattctccgcagcatgataatgggtacgatattcgtgattattactcgatttatcctgaatacggaacgatggaggattttgagcggctagtgtccgaagcacataaaagagacctgaaagtcgtcatggatcttgttgtcaatcatacgtcaacagagcacaaatggtttcgcgaggcgatctcttcaatagacagcccgtaccgtgatttttatatatggaaagacccgcaggaaaacggttctgttccgacgaactgggaatcgaaattcggcggctcggcatgggagcttgacgaagcatcgggccaatactatttgcatctgtttgatgtgacgcaggctgatttgaattgggaaaatgaagaggtcagaaagcatgtctatgacatgatgcatttttggtttgaaaagggaatagacggctttaggcttgatgtcatcaacctgatttctaaagatcagcgctttccgaatgcggaggaaggcgacggccgctctttttacactgacgggccgcgggtgcacgaatttctgcatgaaatgaacgaaaaggtgttttcacattacgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcgccgtttgattttttgaagctgaaggagatcctatctgactggcaaacggggatgcacgcaggaggaggatggaacgctctgttctggtgcaatcatgatcagccgcgcgttgtatcaagatatggagatgatggcgcatatagggtgaaatcggcgaaaatgcttgctacggccattcatatgatgcagggcacgccttatatttatcagggtgaggagctggggatgacgaatccgaagttcactgacataagctcctatcgggatgtcgaatcgctgaacatgtatcacgcctttaaggaaaaaggaatggctgatcaagatattacagccattttacaggcgaaatcccgtgacaattccagaacccccgttcagtgggatgctacggaaaatggtggttttacaacgggcacaccatggataccggttgcaggaaattaccgggaaatcaatgctgaagcggcgctgagagatcagaattcggtgttttaccattatcaaaaattgattcagattcgcaaaatgtatgacattgtgacagagggtacgtatgagataattgcaaaggatgacccgaacatttttgcgtatctcagacacggcagcaatgaaaagctgctcgtgatcaataatttttacgggacagaggcggcctttacactgctggactctttagcgcctgacgaatggaaggcagaggtgctgttgacgaacgatgaagcaagggaagggcttcagaacatgacgcttcgcccgtatgagtccattgtttatcgtttaacgaaaccgtgttaaactaagctgggtggtccataatgaaggtgaataaattcatcacaatttataaagacatcgcacagcaaattgaaggcggccgatggaaagcggaggagattcttccgtctgaacatgagttgaccgcacagtacggtacatcaagagaaacggtccgaaaggcgcttcatatgctcgcgcaaaacggttatatccagaaaatcaggggaaaaggctccgtcgtgctcaatcgtgaaaaaatgcagtttcccgtttcgggccttgtcagcttcaaggagctcgcgcaaacgcttggcaaagaaacgaaaacaactgtacacaaattcgggctggagcctccgtcagagctgatccaaaaacagctccgggccaatctggatgacgacatctgggaagtcatcaggtctagaaagattgacggggaacatgtgattttggacaaggattactttttcagaaagcatgtccctcacttgacgaaagaaatttgtgaaaactccatatatgaatatatagaaggagagctcggtctttcgatcagttacgcccaaaaagaaattgtcgccgagccgtgtacggacgaggacagagagctgctcgatttacgcggctatgaccatatggtcgtggtgagaaactacgtctttttggaggataccagtttgtttcaatatacggaaagcagacaccgtctcgacaaattccgatttgttgattttgcgcggcgggggaaatgagagaggcgcctgcctgcggcagcgcgcttttttgtttggtatcaaaattgatactatccaacaaaaatgtgcgtacttttactttttatcataatggctacaatagagatgagagtaacctaaaggagaggtgttttacatggcagatctaaagaaacaaattctggatgcatacaatttcaggcatgcgactaaggaatttgacccgaataaaaaagtgtcagacagcgattttgaatttattttagaaacaggaagactgtctccgagctcactcggccttgagccttggaaatttgtcgtcgtccaaaatccggagttccgcgagaagcttcgtgaatacacatggggcgcgcaaaagcagctgccgaccgcaagccatttcgtcctgattcttgcgcgtacagcgaaggatatcaaatataatgcggactacatcaaacgtcatttaaaagaagtaaaacaaatgccgcaagacgtgtacgaaggctatttaagcaaaacagaagaattccagaaaaacgatttgcatttgcttgaaagtgacagaacattgtttgactgggcatcaaaacaaacctatatcgcgcttggcaacatgatgactgccgctgcgcaaatcggtgttgattcctgcccgatagaaggcttccagtacgatcacattcaccgtattcttgaagaagaaggccttctggaaaacggaagcttcgatatttctgtgatggtggcatttggctaccgagtgagagaccctcgtccgaaaacaagatctgctgttgaagatgttgtgaagtgggtttaaataaagaaagctgctcgcttagcgagcagctcttttttatgcctgattcgctctattctgttttctcctctgatgtaagtacattgccgttccgagtgcgctgatcagaaatccggccaacaggaccgagtacatggatgtggctgtgtccggaagcaggccgccagccggaccgtctgttcctgatccgcccgaaccgtttcctccagagccgttagtcggttgagtgccgggaggcgtatcatttcctccgtttccgtcagttggctgttttccgcctggtttgtcggagccgccgccatgattgccgtcatcaccgcctgtcggttgatctgacgggaatgcaggcggtttgttgttctctccggaatttaagatcgtgtattcgctgaagtggtttgtatatcctgtcaccatatcatcgtcgactgatccgtgatctgtctttgtgaaagctttctttttcctgtcgacgtggtaaatggcagggttatgggcttcttcaatatcaaacatgcgaagcgaaagctgaacgggctccttgaatgattttatttcttttcctttttgcttcactgtaaagtcatatacatctgccagtgacacatccaattctcccgtcgacttgattccgattgcagtgtctgctgatttaaggttcgccattggcatcttcatgctgtaccagtagttgaacaccgtcaatgaaggatctgattctctttctttcaaaagtttgacctgatcttttttcattttaagattgataggcttctcttgagatccttcatgtgttccataatagacaaacggcgtgttggcatttttagcgtaaatcgcaaatttgtcttcatcaagtgtccagctgccgtcctcctgctttgtcggcaggaatacttctttgatccgtccttcaagcttaggagagaccttgttttctagttttttcagctgttcggtgaaaatctcataatcaacgtagccaaggtcttcaccatgggaggcttctgtaaagacagagtatccgtctcctccggcaccgacaaaattatttgttgccacgcggtaggtatcatccgtatttatagcaattttgtctccgttaggcgattcaattttcacttctaacacacggtgtccaggttcgttgtttaatgtaaaggtatattcgattccggccacctgagggaaagcgccgccgccattttccacattgcttaagccttgttcaagggcttctttaatttgttttccggttaaatcggccacgtaaagcgtattgccgaacggcatcacgttgagcacatcgccgagtgtaatatcccctttgtcaatgccggctctgatgccgccgccatttgttatcgctattctggcaccggctgcttctttggcttttgccagcataccgtccgcaatgaagtttccgagatttgtttctttcgtgcgcacatgctcacgctggccgtcaagcgccacatccgtgtagccgactttttcattttttacgtcttctaattcatttttgaactgatcgagctcttgttttgcttctgggttttcttctgtatgttcatcaattggcagcacgctcagatttgatttatctgtttgcacaacgcctttttcatcaaacgcgacatcaacgcgccccaagaattggccgtattcttttgcctgcgccacgatcgtcggttcttcgctgtttacgacctccattttgtcaacgagggtgtgagtgtgtccgccgatgatcaagtcaatgccttttacttttttggctagctcaagatcacggttatgaccgatatgggttaaagcaataattttatttacctgttcttcttcctgaatcgctttgacggtgttttgtgctgtttcaaaggcatcattgaatacgatgcttttgcccgggcttgatgtggtggccgtatcttctgttgtcaggccgaatacggcgactttctccccgtcaacgtctaacagaatgtaaggatggatgccggcctctttcttttcacctgcggtaaaggtttgcggctttttgacaaatgatttcagtttgggctcatttgacacatctacgtttgcgctgacaatcggaaattccggcgcttcaaagtgatagcggttcgccggatcaacggtcgcgctgtttccgcttagaaaatcagaaagcactgtcgggcctttgtcaaattcatgatttccgaaggtcatggcgtcatagcccatcatgttcatcattttcagatcggccaaaccgttccattttgtaaaatacagatcgccggaaaacacatctcccgcatcaaggagaatgttgtgatttgtttcgctgcgtacttcgttgattttcgtcattcgtctcgctgcatcatcgagatgtgcgtgcgtatcattggtgtgcatgacggtcaggtcccacagtccgtctttaggaggatctggatttgaatcatcatcgaattgcagcttatacacaccatagccttcattcgcagacttgcctacataagcgacgtcgtctgctttatcggcaaatggcttggccaaaagcgaggattcaaacgtcagattcgtgccggaaacaggcgcgattgaccagttgttgtctgcctttggattgactgttttttgttcaataatgtaatccatcagcacctgcctattttcaactgcagagccgtggacaattttatcactcgtcagatgagggaacccgccgcctccggacgcacgatagttattggtgaccacgagaaattcctggcttgggctgatcggcttgccttcataggaaaggttgatgatccgggatgaatccgcattgatcacttttccgttctcattgtatttagccggttttgtcacatcgacctgatatgtgacaccgtcaatcacgtcaaaattataggagcggaaattctcgttcagcaaggcctgatcgccgcctttggctggatcaatttggttgaattggcctgctgacatctccagccagtccttcacttcgctgcctgtcagcttgacgatttgaacagtattatcgtaaaggtacaagtcaccgacatttttaatcgcaagatctccggctggaatgtttgtatagtaattggctccgtttctgccgcctgctttaaacggcgcccccgcagacaaaattggaaggtccttgtactcagtatccttcatttctttttcggcataccatttttgcgcgtcagtcacgatctgaatggaaggatcatctttgacctgtgcaaagaagctgttaatatctgcttcggttttgccgactggctttcggacatactccagtgtgttttggtgtgtttgctgaatggtgtttgtaacggtctcgtttcttgatgtgacgttgccagcaatagattcaatacttcctttggaatctgctaccttccatgagccgtccgccttttcaagcttgaggtcaatcacgcctaaatatttgccccagctgcttggcatgacgacaggaatgccgttaattgttcccttttccacattgaactgagcaacacccgcatactcggaggaaggaaagagtccgtgctgatggcccgagataatcgcgtcaatgcctttcgttttggtggcaaggtcaaacacggcgttttctgcacctgatgattgtgactgcttttcaatgccggtgtgggcgagggcaataatgacatctgcgccttccgccttcattttcgggatcgtttcattggcggattctacgatatcctgcacctgaacctgcccctcgagattctttttgtcccatgtcatgatttgcggcgggacaaagcctatgtagccgacttttactttctgctcattaccgttttcatcaatgagggttttttcattaatcacatacggcgtataacggttttcgccgctagttgttttgacgttggcatttacaatcgggaaatcggctcctttgattgtgccgtcgagaaagtcgagcccgtagttgaattcatgattgccaagcgttccggcgtcgtatttcagcgcattcatgacgctgataatcggatgggttttcgtgccggagataatgtcgtctttttgatatttcaccgcgtattcacccagcggattcccttgaatcaagtcgccgttatccacaagcagggtgttagggttttgctcgcggtgcttttggatcagctgtgccgttcttgccagcccgaaatccgccgtttctttgtcgctgtagtaatcataatccatcatattggcatgaatatcagtcgtggccaaaatactcagatgcacctgaggagccgcgctttcttctgcatgaatgggtggtgttgggaggattaggctaagtatcataattgggggcaaaagaatacggagaatgttttcgacgtgtgttcgtcttttctgtattctcaccagttctccacctttcaacgaaatttgtgttacagctcctattgtaagaatattttgtaactatttgtaggtgtttctttatgattattgtaaaagggagaaaaatgagtattatgtagcagtatcaagcgacaaatactgggtatttatgcttatcgtttgtcacaatcgcggaatgtttattttagtgtggctggggtagagtgttttatgtagacatataaagcgggaggttatgaatcatggggaaaaaaattgcagttgttttaacagattattttgaggacagcgagtacactgagcctgcgaaagcctttaaagaagcgggacataaactgactgtcatcgaaaaagaaaaaggaaaaacagtaaaaggcaagcagggaacagcgggagtgacggttgacgcgtccattgacgacgtaaacccttcagactttgatgcgcttttgattcccggaggattttcaccagaccagcttcgcgctgacgatcgtttcgtccaatttacaaaagcgtttatgactgacaaaaaaccggtattcgccatttgccacggcccgcagcttttaatcaatgcgaaagcgctcgacggccgaaaagcgacgggctatacgtccattcgtgttgacatggaaaacgccggtgccgacgttgtggacaaggaagtggttgtttgccaggatcaattggtcactagccgcacaccggacgatataccggcatttaaccgcgagtcattggcattgcttgagaaataagaaaaaacggacgctcttgggcgtccgtttttttgttgcttaggcttgagcacctgtcagtttcttgtacctgtaatacaagaaagcagctgcagccgttccgatgaccgcaatgccgaagtcgaatatgaaaatatgggcgatgccccccgcttttgcgataagccctgttgcaatcggcagcagaatcgatgcaaggcttgaagcggtcgctacaattccggtaacggttccttttcgcttccagaaaagctctgtcattaacgtaatggtaatttgaaacacacccgcagttgaaaagcctaagaaaaaggcagtgatgtccagcacaactgggatatgaacggtcagcatgactgcgagcgtacataaagtaataataggatataagagcgttatgaagacaggtttgacccatctgttcagcaaaacggctaataataaaacagatgccagagatcctatactataatagctcagcaattgtacagatgctgattcagctaaaccggctgctttttgcgcgtagctcgggagccagatttgagaaaccgtaaataaagccgtggatgtaaaaccgatgataatcagtgcggtgccttccttctgaaaaacgggttcagacaagaaaacgggagattcctgttggccgctattagttggtttcttatgttttttaggaaacgaaagcgttgataaataaataatattcaggagatagaccgctgccggcagataaaaagcaaatccgtaaaacatgctgtggtctgctaaaaatgtgatcaaaagcggcaaaagtgcggccccgacagacataaaggctttgaccaagacattcgccgaaccggaagcagacggaaagagctcggttagggccggatatgttccggcatccatcgctgaatttgcgactccggctaataaggcgaacacaaacgccagctcatagctcggtgataaaggaatacctactaaaaaaacggccataattcccgcagaagcgacaacaagcggctttctgccgattttatctgatagaactccggaaatgccgtatgtcagcagtttgccaaacccgatagcggcaatgacataactgatgccggtcggatcggtattccactgttttgttaatgaagacatattggatgcgagaatgatgttgaccatccccagaaagaagtagttgatatacattccggatgctgttttgatagatgtcgtttgcatgcttgtactccttcaaatcttattcgaacactttgctgtttactgttctaaggaaaattggtttggggaaatgataaaaaagactcgccgagtttccggccagtctcattatttacgaagcgaggctaattcttgagcaatcgcctgcatttcacttgggctgaatgattcttttttcatcaccatgctgtgaaggtacgtgaggtcttcaatcttctcatcactgaaatcctccgctttgattacgccgacgttcagcatgttcagcttttgggaaatctcttcaatcatttgagttaatgtttctgtatttgggctggacaaatggttccatcctttctatgcgcaatataggtatgttttattctaacagaatttcatcagaaaaaaaccctattctaaaagcaggctgtttattccaaaaaagtgaagacatcagttgaaaaggaaatgaacatcctactaagatattcatgaaggtttctttttagagaaataggggcaaagaatagggaggttggacaacatgataagcgtgttatttgtttgtttaggaaacatttgccggtctccgatggcggaagcgatttttcgggaccttgcagccaaaaaaggattagaggagaaaatcaaggcggactcagcgggaatcggcggctggcacatcggcaatccgccgcatgagggaacgcaggagatattgcgcagagaaggaatcagctttgatggcatgctggcgcgtcaagtcagcgaacaggatctggccgattttgattacatcattgcaatggatgcagaaaatatcggaagtctcagaagcatggcgggatttaaaaacacctcacatatcaaaaggcttttggactatgttgaagattcagatcttgccgacgttcccgatccttactacacagggaattttgaagaagtctgccaattaatcaaatcgggctgtgagcatctgcttgcgtctattcaaaaagaaaaacaattgtgagtgaaaggagaatttgcatgaacaacgaacgtttaatgctgaaagggatatttctcggagctgcggcaggcgcggcgttatcactgctccataagccgacaagacaggcgtgcggcatgagatggctgacatgcaagcataaactttcactgtataaaagcaatccggagctgttaaaaaacactgttatcacaaaagtggatgaagccaaaaagctcgcccaaacgctttcaaaggaagtcgactttgtgaaccagcaggtgaaagagctgaagaaaacaacgccgcaagtgatggaactcgtgcaagaaacgaaagagcatttttttaaaaaatgatcaaacatgcgaggtgagacgacatgagttttttgaaagagcttttcagcagatacacccttcatgaaggacaaagtaaatcagcggagctggcgtatttttttctattgtcactgtttccttttttgatttttatgctgacgctcaccgcgtatcttccgctttctaccgatgatgttttaggagtcatagaacaatatgctcccgccagtgcgatgtctctcgttgaatccattacccatcaaaccttaaataatcgaaatggcggtttgctgtcattcgggattatcgccgcattatggtctgcgtctaatggaatgaacgcgatcgtccggtcgctaaaccacgcgtatgatgtggaagaaaaccgctcttttatcattgttcgtctaacctcgatttttttgacgattgccatggtatttacgattttagtggctttgcttctgccggtatttggccgggagattggaaggctcgcttctgactttgtcggcgcgtcggatctgtttttatccgtctgggccgccattcgctggggtgtcagcccgcttgtgcttttgattgttttttccgcgctgtatgtgattgcgccgaacaaaaagctgtctctccggtttgtcatgccgggtgcggtctttgcgactatcggctggatcattgtcagcacattgttttcattttacgtcagcacgtttgcgaactatagcgccacttacgggagcatcgggggaatcatcgttctgatgatttggttttacttgagcggcattttaattatcctaggcggagaaatcaacgctcttttacataaacgtaaaaagcttcctgatgaaaatccctaccattagcgcaccctataaacgaacttcggttcaaaaagaagtcggggggatatcgtgatgaccaagcatacgaaaaaaggcggaagccataacaaacaaaattcgaaaagcaaatcgagccataaaacaagcggaagcgccaacggacaaaacggctaccattagcataaaagcctcctgacatgatgtcgggaggctttttgattaagaagatgaagaataggtttcagccggtgaccagcttttcggtttgcccagcacaagggccagccacacagcgctaagcgtgagagtaatgaagtagaacaagtttgcgctttcaaatgtctgcatataccagccgccggcaaccgggccgaggatgctgccgagactgaatgtaatgccgcaaagcaggtttcccgccggcaggaggtgaggcggaagaagatctgtcatatagctgatgccaagtgtaaaggttgatcctactgccattcctgcaataaaaaagcagccgccgatcacgtaaggcgaaggaaatacaccggcgatgaaaaagcaaagagccccagtcagtaaaatcaccagcagcacattccgcctgccgtatttatcgctgaggatgccgagcggaaactgaaagataatgcttccaatcgcaaatgcgggaaggatgatcgctacagcgtctactgatatccccaaacggagcgcgtacaccggaaagcttccgttcagcgccgtttccagaaagccatagccaaatgtaggcataaaggcaacccacccaaacagcatggcctgataaaatcgcctgaaactattgtctgatttggtttcatgaggactggtttccgggtatgcattttgtagaaagaaaacaaaaagccacgcaaacagactgatgcagccggacacgataaaaggaagcgacggactcagcttgacaagcggcaccatgaacgggcccgcggcaaagccaaggccaaaggaaagcccgtaaatagacaggtttcttccgcgattttgttttgatgacatggaggtcacccacgtttgcgtagaaaagtgaagcatgtggtcgccgattccaatgaacaggcgaagcaggaaccagacccaaactgactgaagccaaataaatccgaataagcttaaaatgacaatgcttccgcccatgacgatcagcggcttgaacccgagctttctgagcggcgcttccataaacggcgaagccaaaagcacaccgatatacagcccggtcgcgtgcaggccgttgatcgcagcggattctccatttgtttcaaaaatgattgaaatgacaggcagcagcatgccttgtgaaaacccggaaatggatacgagcaagacaaggataaagaaatgaaatcgtgacatcgtgtcagttctccttatgtggaatctatgttgatcgtacaatgttttccaaaagcaggcaacctgaaaaaagcctatatcacgctatacatttgccctcgtgtaatcatgaaggtttttgtgaagaataaaaataaaacaagtcataaaaaaggagctatttcaccatgaatcgtatcttttttattttagtggcggccggtgttccgctttctgtgattggcagtttgatgcattggccttccgcggttctatttgcagtttattgcgtgacgattatcgcgcttgcaagctatatggggagggcgacagaatcactgtccatcattgcaggaccgcgtatcggcggtttgttgaatgcaaccttcgggaatgcggtggagctgattatttccctttttgcattaaaagaaggcctgacaggaatcgtgcttgcctctttaaccggttcagtgctggggaacctgttgctggtagcgggcctatcgttttttgtcggcggtttaaaatataagcggcaggaatttaatatccatgatgcccgccataactccgggcttctgatttttgccatcattgtcgcctttgtgattccggaggtattctctgttggtatgggaaacgccagcaagctcaatttaagcatcggcatcagcatcattatgattctgttatatgtggcggcgctgtactttaaacttgtcacgcatcggggcgtttatcagccgaataatgccgctcagactgaagaagaggaagagccagaatggtcagggaaggttgcgacgattgtcttgtttgcggcaacgattgtggttgcatacatatccgaaaacctggtccatacctttcactcggtggctgaacagttcgggtggagcgagctgtttattggggtcatcatcgtggcgattgtaggaaatgcggcggagcatgcgtcagcgattattatggccttcaaaaataaaatggacattgctgttgaaattgcagtaggctctacgctgcagatcgctatgtttgtcgcaccggttctcgtcatctgttctatcttttttccgacaagcatgccgcttgtatttacattgcctgagctcgtcgcgatggtatcagcggttctcttgatgatcgcgatttcgaatgacggggattccaactggtttgaaggtgcgacactgcttgctgcatatgtcattatggcgatcggctttttccttctttaacctgaaaaaatgatggataacaacaaagcgggatgaaaagactaagggaaaatgccatagaaagagtgatatgatgaaaaagctatttcattccacacttatcgtgttgttattctttagttttttcggcgttcagcccatccacgcgaaaaagcagtttaaggttcctaattctgtcgcaagcatttcaaaggaaaacacgtatccgaatgcttcacaggatcagccaatgcttcagccgagcaagctggcaaaggaattgctcgatcattctgaggtgaagattgaaaatccgcatctcatcaaaatgctgaatgaatccaacatatccggcacaccgcttgcagtagggtaccgggcgacaatatttctcgggaaatgggcgctcggctatgaatcaaatgaaacagtcgcaaactgggaatataaaaaaatcaatacaaaccgtgcggataaccgcggcgggaaagaaacggctgaaatgcattatgcccaggaacagcagtacagagtgaagggcggcctgacagctaaagttccaaatgctgaagatgtcaaaagcatgatgatgcaaaaagcaatgaagaaaacgaaccttccgcttgcatttgagacggtcattggggctggcacaaaacgggatcagatttataaagtcgctcctaaaaaaatcggttatttacatgcatatgcaccggctgtgaatgaaaaaggaaaagtgacttacggagaagtgtacttagtgctgaaaggaaataaacgaaaactcgtcgtgaaaaatgtcacgtcacagggcatcggcgcgtggattccggttcaagatcatgtcacatttggctttcagctttcctcactgccaagataaataaaaaactgattccaactcggaatcagtttttttgtttattgggttctctcgattcggaccgcttcctcaagcatttgcacattgttttggtagagctggcgaacgagaacccgtctgactgcaaggctggcactgaaataatcatcatctttcaccatgcctttaaccgtaaattcgacgccgcgattgattttattcaatgcggtgatgccgtggatttgaaatggttctgtcggattgccgaatacatcccgcttcaatgaatcacgaagctcttcattcagcatgtcacatgcctcttccaacacgctgtacacgcggtccggatcttctttaaagctgataagaaaggattcggtaatccgcataaaatcaatattatagttctctatttgtctgacctcgccgttgctgatggtgagcagcttcccgctccattctcggatttgcagcgagcggaggccgatttcctccactgtcccgttgaacaagttgttgatggtgacataatcgcctttgtgcagctggcgttcatatattaagaacacaccagccagcacatctttgatcagcgattgggcgccaaaaccgatcacgatacctgctacgcccgccccggccaatatcttgccgaaatcatgcacaaataaagaaataacgtaaaaaataaaaccaattgtcgccgtatactgggtgacagaacggacaaggctttcaatcgttttttcctttttttcttcaataaaatccgtccgtttaaaaaatagctgtaccagccggttgatgataaagacaccgatccaaaggataacggcaacgaggagaatatcgacgattttattttgaaaaatctccgtaagtgtttctttcatccgcatctaactcctggcttgacgttttgtgaagtctgtatcctgataataactgtttttgacaagaacattcggtccgaggcaccggacattcgggcagtggcaacttagttccttcgcaagcttggtctctctccacttttcataggcggaagggaggctgtccgtctgaatgttgccaagcggcggggtatcaccgaaatcggtcacgataatgtttccgtcgaaaatgttcacattcaggcgggatcggccgtcagggtcatttcgcactgtgacgtttttcgccgcgcgaagccggcgaagcagcttttggtcgtcttcgtccggactgcaggcataaaacggcagcgttccgaacagcatccacgtattttcatcacgaatatccagcaagcggtgaatggcctgtctcatctctttcaggctgagggattcaagagcgcttgcgaaatcgcttggatacattgggtggacctcgtgacgctgacatttcatatcttctgtgatttggcggtgaatatgctcaatatgcggaagagttcgtttgttcagcatcgtttccgcagataccattactccggcatccacgagcgtgcggctgttttcgatcattttttcaaaatagcgcgcgcgctgttcgaaggtcggttttctgtccatcatggcaaagccgatttcagcaaaatcttcaactgtaccccagttatgagaaatatgtagcacatcgagatacggaatgatccattcgtaccgctcgatgtcgagggtcagatttgaattaatttgtgtccgcacaccccgttcatgggcatatttcaataaaggaacaacatattcttttactgatttcaacgaaagcatcggctctccgcctgtgatgctgatggatctgaggcgcgggatttcctccagccgttttaacagaagatctattggcagagcattcgggtctttaggctgcaatgtatagcctacagcacaatgctcgcatctcatattgcacagtgtcgtcgttgtgaattcaacgtttgtcagctgcatgtctccgtattggtcaacatccatataggcttcccaagggtcaaactcgggcgtaatcggacgcagcttcgtgttttgtgtcatgactatctaactcctttataaatgggcatactaacgctgccaacagttaattttagacctgatttgccaagatcgcaagtagcgcggcgattgaaaaacggcaaaaaatgagctaccataataaaaaatgaatggaggaacagaatggggaacgccgtaaacaataaagatcagcagattgattatttaaagaacagacttgacatgtttatgaacgtcatcgattcattagaccctgaagcaaccgacgttgaagatatagacaggcttatcagcatgcttgatgacctggaagccaaatacgaacgttttaaaaaagattgggaataaaaccgcgtgcccgccgcggtttttttattggcataaagcaacagtataaaacaatgcccctatctgtaaaataagaaaaaatgcagaaggagcgctggccatgaagtggatgtgttcaatatgctgcgccgccgtattgcttgccggaggtgcagcacaggcggaagcggtgccgaatgagccgattaattggggctttaaacgaagtgtcaatcatcagccgccagatgccgggaagcagctgaacagtttaattgaaaaatatgacgcgttttatttagggaatacaaaggaaaaaacgatttacttaacgtttgataacggatatgaaaatggctatacgccaaaagtgcttgatgtcttaaaaaaacatcgcgtaacaggaacgttttttgtcaccgggcatttcgtaaaggaccagcctcagctgatcaaacgaatgtcagatgagggccatattatcggcaaccattcctttcaccatccggatttaacgacaaaaacagctgatcagattcaggatgaactagattcagtcaacgaagaggtttataaaattacgggaaagcaggacaatctgtacttgcgtccgccgcgtggcgtgttcagtgagtacgtactgaaagaaacgaaacgcctcggctatcaaaccgttttctggtcggtcgcttttgttgattggaaaatcaacaaccaaaaggggaagaaatatgcctacgatcatatgattaagcaggcgcacccgggagccatttacctgctgcacaccgtatcaagggacaatgctgaagcactggatgacgcgattacagatctgaaaaaacagggctacacttttaaaagcattgatgatctgatgtttgagaaagaaatgaagatgccgtccttgtaatgagaagagcctctcctgaaatggagaggcttttctttattttatacatttaatcagtgcggcccagtccagatctccgaagccctgttcaatcccgctttcaaaatggctcttggccagctcggcaagaggaagatttgcagaaacccgttttgcggcggcgagtgccaggttggtatccttcagccctaaagacattttgaagccggccggctcaaatttctgctcggccataatggttccgtaattttgatagactggagaaccaaagagcgcgctggcgatttctaaaaattgtttttgttctaagccgtatttctccatcattaaaaaggattcagataacgcctccagcatggacacaagcaagaaattgatgctgattttggctgcatttgccgtcttgctttcttcgccgacgtcaaatacctgctggctcaggctgtcgagcagaggcttggcagcttgctttgcttccgccggtccggctgttatgatacggagcgcggctttggctgcggcatccggtctgccaagaacaggagcggcgagaaaaaattgtcctttctctgcatgagctgctgcgagcttttctgagaactcaacactgattgtgctcatcgagatgtgaatgccgttctctgctaatccttcaagcagcccgtcttctccgaatgtcacggcgctgacagaatcatcatctgcaagcatagtaatgacaatatcagcggactttgccgccagccgcggcgtatcagctgcctgtgcgccttttgtgacaaattcttctgtcttttgtttcgtccggttatagacagtcaattcgtagcctgcttgaagaacatttcgggcaatgggctgtcccatattgccgagtccgatgacagcaattttcaatctgatcactccctgaatattttttccattataaacaatatgaacagaatatgcatagcgatcggcttacaacaaaaaagaacagctgctcgctgtcctcatttaaaaatattgaaccatcctttatgtacaaaccaaatcagcatcccgatcacaagcgcggccatcaggccaagtacagcaaaatatccgtatttccaatgcagctccggcataaagtcgaagttcataccgtatacaccggcaataaaggtgagcgggatgaaaatggttgatacgatcgtcagtgtcatcataatcgcattcatccggtttgagtttagcgtcacgtagctgtcacgcaagtcggacgtcatgtcacggttggattccacaatttcagacaactttaacaaatgatcgtatatgtcactgaagtaggctttcgtttcccgctgctctttcacatggtcaaggcttaaaatccggtagagcaaatcacgcatcgggataatcgtccgtctcaaatgcaataggtctgttctgagatcaaacacctcgttcatcagcgttccatacgttttgtggggacggctttcttcaatttcattcagccggtcttcgattttgtacacgagaggaaaatattcatcaacaagctgatccatgatcatataagaaatatgcccgggcccttttttcaatatatccggtgaagcatacaaacgctcccggactttagcgataccgggcgtttcgtgtaaatgaaaggtgacgacaaatttttcgccttgaaagatatcgacttcctccgtctcaagtgtttccttattcagcgcatgaatcacgtaaaaacgatagccgtcataatggtcaagcttcggccgctgcatatgctggaagcaatcctcaatggcaagcgggtgaaaatgaaaaaaatctctcaataacgccgtttccgtatcctccgggccgtaaaaatcaacccagtaccatgcaatatcaggctgttccactcgttcgatcggtatatttttcagcagctgatgctctgttgtgattgcggtaatgttgatcataaacaaccctccacctgccattatatcatgcggtctttatgagaaaagtatacggtactctctgcctaattcaagcggcatgttatactgaacaaaaacggaaaaagggtggatctcatgtggaaggaaaaagtatctgtcacgcctccgtatcattttgaccgcgtgctggacaggctgtctttagaccccctcaatgctgttgatcgagaggcgagggaagtccgtgtgccaatcagaaatcaagcgggggacgtatgtattgtaaaggtacaagcgttaggccatgcgggtgagcctgagttcctcgtcagcggggaaacggatcagggagaaatgatgaaggaaatcaagcggatttttcaatgggaaaatcatttgcagcacgttctggatcatttttcaaaaacgagcctgtccgccatttttgaagagcatgcagggactccgcttgttctggactacagcgtgtacaactgcatgatgaaatgcattatccaccagcagctcaatctttccttcgcttacacgctaacagaacggtttgttcatgcgtttggcgagcagaaggatggcgtgtggtgctacccaaagccggaaacgattgcagaactcgattatcaggatctgcgtgatctgcaattcagcatgagaaaagcggaatacaccattgatacatcaaggatgatcacagaaggcacactcagcttgtcagagctgccgcatatggcggatgaagacattatgaagaaactgatcaaaatcaggggtatcggcccgtggactgtgcaaaacgtcctcatgttcggacttggccgtcccaatttattcccgcttgccgatatcggcctccaaaatgcgatcaaacgccattttcagctagacgataagccggcaaaggatgtcatgctggcgatgagcaaggagtgggagccttatttaagctatgcgtctttatatttgtggaggagtatagaataattcatctgacaatgaaggaaatcctgcaaacgtgttatactagaaagatgtgaaaaaaccatttcactttctgccatctgcagaaagctttatatagaaacggagagaacaacgtgaaccaacaaaagaaacaggcgcccgtcgaactgaaggtcggacaaacctttccgctgacgattaagcgtctcggcattaacggagaaggtgtcggctattttaagaaaaaagtcgtcttcgtacccggcgcgcttcctggcgaagaagttgttgtgcaggccacaaaggtccagccgaagttttcggagggccgcattaagaaaatccgcaaggcatctgagcaccgggtggcaccgccttgccctgtttatgaacaatgcggcggatgtcagcttcagcaccttgcatacagccagcagcttcgggaaaaacgcgatatcgtcattcagtctcttgaacgccatacgaagtttaaagtggaaaacatggaaatcaaagaaacgattggcatggacaacccgtggaattaccgcaataaaagccaattccagatcgggcgctcgcaaagcggcagcatcatcgccggcttatacggccttgattctcatgacatcgttccgattaaagactgtatcgttcagcatccggcaacgaacaaaacaacaggcatcgtccgccgcattttagaggacttcaatgtgtctgtttataatgaaagaaaacgaaaaggcgacgttcgcacgatcgtgacgagagtcggctttgaaacaggcgaagtgcaggtcgtgcttgtaaccgcaaaggaatcgcttccgcacaaggaagaaatcgtcaaagcaattcaaaagcgattgccagaggtcaaatccattattcagaatgtaaacggggcgaaaacttcagtgattttcggtgagaaaacaaaaccgctcgccggaaaaacagtaattcaagaagtgctcggcgacgtatcttttgaattgagtgcccgcgctttcttccagctcaacccggaacagaccgtcaagctgtatgatgaagtgaaaaaagcggcgcagctgaccggaaaagaaaaagtcgttgatgcgtattgcggcgtcggcactatcggcatgtgggtggcggacggagcgaaggaagtccgcggcatggacgtcatcaaggaatcaattgacgatgctaagaaaaacgccaaaaaacacggtatggcaaatgccacatatgtaacaggaacagccgaacactggctcccgaaatggacgaaagaaggcttccgcccggacgtcgtcattgtagacccgccaagaacgggctgtgacagcacgttcctggacacgatcaaaaaagtcaaaccgaaacgcttcgtctacgtttcctgcaatccatccacgcttgcgaaggatttgcagacgctgtcgaaggactatcgcgtggactatattcagcctgtcgatatgtttccgcagacggcgcatgttgaagcagtggcgagacttgtattgaaatcgtctaactaaaaagaacatttcccagtcataaaatagttttcctaataagacctggatttcggtaaaataaacaattccgatttccgggtctttttcgtgcgcagcccttgtcctaactgtctttccccaattttatcttccttcttttctcggagatctttattttaactggcgaaaagaattgaaaaaacgtgttgaaaagcgggtgaaaaaaagcgttatttaaccggaaaaatttccttccagtatgattaaaatacatgagtaaaatgatgtaaaatcatagatatatttttcataatttgtaaaattatatattgacttgcagttattacgtgtgaaatattgattataggaatataaggaaaggtatggcgtatatcatttcaagagtcattcgatgtaaaaagttgaaacattgtaataaacgaaagaggtgaaaatgatggccaaccccattttaaaatgaataacgtatgagcactacaacaattaaataatagtgccgacgataacaactattaaagtaatacctacaatggttatatccttgcgacaatcatgcttcataataatttagattgacacttggctaaaaagtattgcagagaaggaaatggataactaaatggataaagtatataaaaaacgaccgttatataaaagaagttggtttcaaacatttttggcatttttagtatctcagctttattttaattttgtagaattaacgggatggggtcctaagtatagagaaatgaatggattcccagcaaacatagttgaactagatttctttcaaacatatctttcattctatgataatccatggtttaatattattactgttttcttgggagttttcactattatacaaataattacagggataacaaaggatattcgaaattaaagcaataacttctgatgccttatttaatgatgaaagaaaatgaacactttcttaattatcttatgagtgaagactgcgacatttagtcagcagtctattttattggttctggatcaggattaccgaattataaccctatacaaatatatagtaggttgccacttgctgcgttggttattttctaaatcatgagcaaatcccaaacgatccagattgaagttcttgaattctttaaaataagggtttattttctccctcttcctctttactccatgtgattcacaaggtagcagcttaagtaggttttttcgttctcttgagtactcagttataccacccccaactcaatttgcttaatcaaagtttatctcttgaaattagtttttccgcaaatatgatattgagatacggatatggtgtagcgttaaatatcttatcttcaataacagggcaattattttgcgttggtaatatggagaactcatatgatattctatttaggttggaatcctttttatccaaaagttcaaaagtaaggccactaagaaagacgaaggtcagcgcgagttaaccacaatataaaaaatagggtagataatcatcccacgtgaaatgttcaaaatttactatagattgataagaaatgctttcgcatgcgataagtgtaaaaagaagcatggtcagtttttaatttgggataaaggttcagccgtatcccataatgaaaggatttgaatgtattatgacagataatttctggcgtgaattgccacggccattttttgtactggcaccaatggaagatgtgacagatgttgttttccggcatgtagtaagtgaagcaggcagaccggatgtattttttacagagttcacaaactcagagagctattgccacccggatggaaaagatagtgtgcgcggccgtttgacttttacagaggatgaacagccaatggtagcccacatatggggggataagcctgaaaacttccgtaaaatgagtattggcatggcagagttaggatttaaaggcttagatatcaatatgggctgccctgtacctaatgtggcagggaatggaaagggaagcggccttatttgccgtcctgcagtggcggcagaattaatacaagctgcaaaagcagggggattgcctgtaagcgtgaagacaagacttggatacacggatgtggatgaatggcgcgagtggctgacacacattttgaaacaggatattgccaatctttctattcatttgcgtacaagagcggaaatgagcaaagtagatgcccattgggaactcatcccggagattaagaaacttcgtgatgaggtggcaccagatacacttttgacgatcaatggtgatatccctgaccgtcaaaccggcttgaaacttgctgaacaatacggtgttgatgggattatgattgggcgcggtatttttacaaatccatttgcctttgaaaaggagccgaaagagcatagcagcaaggaattgcttgatctcttaaggctgcatctggatctccatgacaaatattcagcattagaagcgcgtccgtacaagcctcttcctcgctttttcaagatttacctccgcgggttccgaggggcaagtgaattaagaaatcaatgcatgaacacaaagtcaacagatgaagtgcgtgcattgctcgacgactttgagagaaagtatcttgatgggatagagtaactgcagtgcttgattcaaaaaaggctaacacaattcttgactaaaatacctggattttcggtaaatccgggtcttttttgtacgcagctttactcagcctgtcttttctctaatttattgtaagaaaataatggtatatttagtggagatatcttataaagggggagagaaaattgaaacggctatgcatcatcccctgcggcaagaaaaaaatctgggacgtccagcctgatgccgggccggtaagagcagaggacgcttatctcagcccgtttcatcaggcgtgcgagcggtatgcgaaagcatttttcgatgagtgggtgattttgtcggcgaagcatggctttcttcgccctaatgatctcgtttcgggaaattacgatgtcacttttggcaccggtcatccggaaatcatgacagcggtcgagctaggccgtcaatttcacgaaaaaggcttttctgatatcgaagagctagtcatgcttggcggaaaaaaatatcgaagcattctaaacgccgtcatcggagaacaccagcatatcagctggccgctatcatcatacaaaggcataggctacatgctccaagcgctgaaccgggctgttgaagaaaagcatgaactgtagcacatacatatgaagaaaagagtgtgaacatgaaaaaacttgtgtttggcttgcttgccattgcattattcggatgcggactatatatctatcatgtatggttcggtgatccattttcgaaaaatgctgcagaacagaagctagtctcttatgtgaaacaaacctatcctaagaaagaaatcaagatcacgaatggggtatataacgctaaaacctctgaatatgtattcgaagcaacctcccaatctcatcgctacccaatgtgtacgaagggatttctgcatcctaaagtaacgtgcgatggaattgaagaagcgtataccgaatcagtatcaaaacatgtaaatgaagaagcaacgaaggcaatcgaagcagatctgaaaaaagcggttcctcgacttataaaagctgatgctgctttgagtattgaaaacggacagttcacgttagatacaaaatggaacaaacagctggctgaaaaagcgcctatgagcatgacgattcagttagacgccagcgggttatcaaaaacagatgccgcaaagatggcggaaacggtcagaaaaacgcttaatgaaaagggatatacatactcaaacggcacgatagactgtatgcagaaggacggggacggcggtattggatatgtcaaatattcaattgattttctttcaaaagcagctattcagtcaaacgatgcagaggaactaggaagttaaaaagatttccaaggaaataaatacgtcgatcattgtcaaaggccgggtgatatccggtctttttttgcatgctgtaaaacgagacaaatgaatcagtttgagacaaaacgagacacccgtctcaaactgtctccaaagtgaagacgagaagactggttttacgggctcaaaagactggcacacttcttgcatttataatggtgaaccctaaatagaaggaggcgcacaaaatggaattgttaaaacgagaaggcttatcattaactgaggaaaaagcgctgtggatgtaccaaaagatgctggagatcaggggctttgaagacaaagtgcatgaactgttcgcccagggagtgcttcccggattcgttcatttatatgccggtgaggaagctgtggctgtaggggtgtgcgctcatttacatgatggcgacagcattacaagcacccacaggggacatggacattgtatcgccaaaggctgtgatttggacggcatgatggcggaaattttcggaaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggcaccttccacgaagggctgaatttagcggctgtatggaaccttcctgtcgtgtttgttgctgaaaacaacggctatggcgaagctaccccatttgagtacgcatcagcctgtgattcaatcgccgatcgggcagctgcttataacatgccgggggttacagttgacggcaaagatattttagcagtttaccaggcagccgaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaagattcggagctgctgacagatgtgtatgtttcatatgaaaaaggaggaatgtaagagatggcgagagtcataagcatgtcagacgcgatcaatgaagcaatgaagcttgcgatgagaaaagacgaaaatgtgcttttgatcggtgaggatgtcgccgggggagcggcggtcgatcatttgcaggatgatgaagcatggggcggtgtattaggggtcacaaaggggctcgtacaggaattcgggcgcacaagagtgctggacactccgatttctgaggcgggctatatgggtgcggctatggctgcggcatcaaccggtttgagaccgattgccgagctgatgtttaacgattttatcggcacgtgctttgaccaggtgatcaaccaaggggcgaaattccgttacatgttcggcggaaaagcgcaagtgccgattaccgtccgcaccacatacggagcagggttccgggccgctgcccagcattcacaagcgctgtatggccttttcacgagcatccctggactgaagacagttgttccatccaatccgtatgatgccaaaggtcttctgcttgcagcaatagaagataatgatccggtattcttctttgaagacaaaacgtcctacaacatgaagggcgaggtgccggaagattattatacaattcccctcggaaaagcggatatcaaacgcgagggcaatgatgttacgctctttgcagtcggcaagcaggtcaatactgcgcttgaagcggctgcacagctttcagagaggggcatcgaagccgaggtccttgatccgcgcagtctgtcccctctggatgaggatgcgattttcacatcgttagaaaaaacaaaccggctgatcatcattgatgaagccaatccgcgatgcagcattgccacggatattgctgcgattgtcgctgacaagggctttgatttgcttgatgcgccgattaaacggattacagcgccgcatacaccggttccgttttcaccagtgcttgaagatcaatatttgccgacaccagataaaattgtcagcgtcacgcttgaattgcttggcgagccggcaatgaattaaagggggaacacaaatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagcaatctgctatatcggggacgccaatgagtcggtgcaggaagaggcgagcgcgcctgttgctgaagacagtgtgccgcaagccatccagcccgtcaaacaagaaaacaaacccgcagcctccaaaaaagatcgaatgaaaatatctccagtcgccaggaaaatagcagaaaaagcaggattagacctaaaacagctgaaaggaactggaccaggcggacgaatcgtgaaggatgacgtgacaaaggcccttgctgaacagaaaaaagatcaggcaaagcctgtgtcggagcagaaagcgcaggaaatcccggtgacaggcatgagaaaggtcatcgctgcccgaatgcaggaaagcttggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcatcatcacacatcctcatgtgcaccttggtatggctgtagccttggaaaatggcttagtggtgcctgtcatccgccatgctgaaaagctatcgttgattgaactggctcaatctatctcagaaaatgccaaaaaagcacgcgagggacgtgcgggaagcgaagaactgcaaggctctactttctccattacaaaccttggcgcgtttggagttgagcatttcacaccaatactaaatccgccggaaacaggcattctcggcatcggagcaagctatgacacgccggtgtatcaaggggaggaaatcgtcagaagcacaatcctgccgctcagcctgacatttgatcacagagcgtgtgacggcgcccctgccgctgcattcctgaaggcgatgaaaacatatttggaagaacccgcagcattaattttataggaaaagcaggtgaaaacgacatgacattagccattatcggcggcggacctgcaggctatgcggctgcggtttccgcggcacagcagggcagaaacgtgctgcttattgacaaaggcaagcttggggggacctgcctgaatgaaggctgcatcccgacaaagtctttgttagaaagcgcaaacgttcttgataaaatcaagcatgccgacagctttggaatcgaacttccggcaggtgcgatatcagtcgattggagtaaaatgcaaagccggaaacaacaggttgtcagtcagcttgtccaaggcgttcagtacctaatgaagaaaaatcaaatacaggttgtaaagggaacagcctcctttctttctgaaagaaagctcttgatcgaaggagaaaacggaaaagaaatcagagaggcggaccaagtattgattgcctccgggtcagagccaatcgagctgccttttgccccgtttgacggcgaatggatcatcgacagcaaagacgcgctttctctttccgagattccgtcttcactagtcattgtcggcggcggtgtcatcgggtgtgagtatgcagggctgttcgccagattgggatcgaaggtgaccatcattgaaacagcggaccagctgatcccggctgaagatgaagatattgcccgtctctttcaggagaaacttgaggaagacggtgtcgaagtgcatacttcatccagattagggcgggtggatcaaacggccaaaacggcaatatggaaaagcggtcagcgagagtttaaaacgaaggccgattatgtgctagtggcgatcggcagaaaaccccgtcttgacggattgcagctggaacaggccggagttgatttttctccaaagggcattccggtgaatgggcacatgcagacgaacgtgcctcatatttacgcgtgcggagatgctatagggggcattcagctggcgcatgccgcttttcatgagggcatcatcgctgcttctcatgcttccggaagggatgtcaaaatcaatgagaaacatgtgccgcgctgcatctatacgtccccggaaatcgcttgtatcggaatgacagaacgtcaggcaagaagcatatacggcgatgtgaaaattggcgaatttcctttttccgcaaacggcaaggcactcattaaacagcaagcggaaggaaaggtcaaaatcatggctgaaccggaattcggcgaaatcgtgggtgtctcgatgattggcccggatgtaaccgagctcatcggccaagcggcagcgatcatgaatggtgagatgacggcagatatggcggagcattttatcgccgcccatccgactttatcggaaacattgcatgaggcgctgttaagcacgatcggccttgcggtacatgcataataaaggaaaaagcaggcgcatggatataaggcgcctgctttttttattgttgaaagcgctttatttttcccctacaatagatgaaaacggcgtgtaagggaggagcgatcaaggaaatgaattcggtcccaaacgatttgcaaacctggaaacgttttgtgaaagacggtgtgcttgacgaagcccgattaagaaaacggattgcagagtcatggcatcgctgcaaaaaagctgaggtcaatccttatttagaaaaaggcccgaaggttttacagcaaacggagctggatcagcagtcaaaaaaacattcattcttcttgacgaccgcaaagccttacctcgaaaaactgctgcctgccataaaagaaatggaaatgatggcgctactaattgattcagacggtgttgttttggcattggacggccattcccgcgcgctctatgaagccaaacgcatcaactttgtcgaaggggcatgctggacggaaacggctgtcggaacaaatgcgattggcacggcactccacattagcgagccggttgcgatacaaggatcagagcattactccattgcttcccatctttggaactgttcagccgctccgattcaccatgaggatggcagccttgcgggtgtgattgacatatcgtgtccggcggcaggcgctcatcctcatatgctcggtattgccactgcgatcgcctatgcagctgaacgggaactcgcagctaaaagccgtgagaaagagctcgagctgattagccgttttggagagagggctgcatccagtgtgccgatggtgctatgcaataccaagcagcacatcatcagtgcgagcataccgattcgaacctcaataccggattggcagggccggcacctgtatgagctgaaggaacggggctactcaatcgaaaaagctgtcaccataggagatggcggcacttgtttttatctttcggaacaaaagaaaaagaaggtgtttcgattcaatggagtgatcgggcaaagcggccgatcgcaagcgatgctgatgaaccttgaacgtgcagctgcggcagatgcaacggtctgtttgtcgggcgaaactggtacgggaaaagaagtcgcggctcgcgcgcttcatgagaacagtgagagacggcacggtccgtttattgctgtcaattgcggagcgattccgtctgatttgattgaaagcgaactattcggatatgcagagggcgcttttacgggagcgaaacgaaatggctataaaggcgcctttcaaaaagcgaatcaaggcacattatttttagatgaaatcggagaaatttcccactcgatgcaggttgcgcttttacgagtgcttcaggaacgtaagataacgccaatcggcgggacgaaagaaattccggttgatatcagagttattgccgccacacattgtgatttacgcgagcttgccgaaaacggaaaaatcagagaggacttgttttaccgtcttcatgtctatccaattgaactccctccattacgcgatcgcaccgaggatatcccggacctctttgagcactacaaacagaagaatcattggcccggcgaacttccttctgatttttgtgatgtgctgaagcaatggaagtggccggggaatatccgtgagctgtttaatgtgtttgaacgtctttctatcagatttccggacggccggctgagggatgaaccgctacccgctttactggaagctgctggattgccggccagctctgcagaaaaaaagccggctgctgccggcgtgctttcctttcgtgagcaaatccaaaaggatatgatgatcaaagcgcttgaatctgcaaaaggaaacgtctctcaagccgcaaaaatcagcgggatcccccgaagcactttctacaaacgcctgaaaaaattcaacttgtccgctgaatcataaagcatacttccttcaggaaatggaaacgttatgtattgaaggagggtgttacgatgaatattcaaagggcgaaagaaattgtagaatctcccgacatgaagaaagtaacatacaacggcgttcctatttacattcagcacgtaaatgaagaaactggaacagcaagaatttatccgcttgacgaaccgcaagaggagcatgaagtgcagctgaacagcttaaaagaggattaaacaaaaatggcccgcttcataagcaggccattttgttatccgcgcggcgcaaataaaataacacagacaccgatgagacaaatgaatgcgccgatccagtcatacagatcaggtgttttccggtcaataagccatccccacaggactgcaagcacgatgaatactccgccataagcggcgtatacacggccgaaagatgggaaggactgaaacgtcggaagaatgccgtatacaatgaggatcagcgccccggcgattccgtagccggctggctttgcctctctcagccatagccaaaccagatatccgccgccaatttcggcaagccctgccgcgagaaataaaagaatggtaatcagcatcatgagcactcctcaatttgcatttatctttcattatagaggaggagagcttttaaagcttcggatgattctcaaattccttcaaatacgcactgcgttggatgtctgtaaactgtccgatccaattgcttttcgcctcttcattcaaatggggaaggatatagcgttcaaccgcttcgaaaaacagcggattcgcgatgatgttccaggtcgggatgcgaacgattttcccgtctgttttctcgatgataatatcctcaaaaaagatccctttcaaactgtattgatggcgtcccatataaagccgcttcacctcggaaaacagtacgctgcgctttctcgaaaagatctcgccattaggtccggtctttatgctgaaaatgacatttccacggcttgtgaaggcaggaaaagccataaagaatgtgatcaatccataaatcatcgccagtaatccgccgcccaaataaagcagggcatatttagattcaaacgtgagagcttcagacaccagccagacgcccacaataaaggcggcccctgtagcgaggaacagccaagcccttagaaacatcatgctttttacttcaatcatgtgctgcccctaaagcttcggatgattctcaaattccttcaaatacgcactgcgttggatgtctgtaaactgtccgatccaattgcttttcgcctcttcattcagatgtggaaggatatagcgttcaaccgcttcgaaaaacaacggattcggaatgatgttccaagtgggaatgcgaatggtcttctgatcaacagtttggatcaatatatcttcttggaaaattccttttagactaaatttatggcggctcatctcaattttcttgatatcagtaaacgtaacagacactttgtcagtgaacacttctccattttttcctgtcttgatgcggaaaatggtatttccccgcggggtgaaagccggaaagaagatgataaataaatataaacaaaacaaggtgaacagaaagccagcaggaatggctaataggtaatatttcgtttgaaacgtaatacccatataaaagagccacaaacatgctaatcccataccggcagatccgacaaaagcccatattctcaggaacattttgcttttgacttcaatgatttcttggtttttcaatgcttttctccttttgttaattcaattcttatcattttgaaatgatttgatttacaacatccttatgagcagggaggatagaaaattcattctgggtgatgcctgtgacaagccaagtatggtgggcccccggcaggacaaatgccatgtcagccacttcaggagtgttatctttgccatatgccagacgcataagtgtatccattttccctttccgcaaagccagatcatttgcaaatcgggtaacgtcctcttggtggtcatgtttttcaaggaactcttttagatatgaagggttgtctgaagcgccctccaagagtttttcaaattcatttgatgtcaatgtcacaatcgattctcttttatcctctgtatctattatatgtaaaaactcatctgtcttagcaagtaacccttcacttgattccatttttgtaatgcgatggacttgttcatcaaaaaggagttcgtgagagtaggtgccgaattttgatacatggcaggacacattctgttcggcgccttgcccgttaaatttagaaagcttcactgtatagtcagcgtcgtttaatacatggataaacggacagtactcgtcctttaaccgatattgatggttccgatattccgctgcatccttagctaagagtgagcggcaagctgcttcgaacaaagcgccgagctgttcatcttctatttccggaaaataggcctgcttcaaggccatcccctgttcaaaaaacccttcgctgtaaaagcaaaataagagttcttctatgctaattgtaaactgcttcattgtttattctcctatccaaatgaaaatttccctttaaggaaatgggttgcgccgtgtataagcgaatccgctgttttctttgctttttccattccttttttcgcgctgtctatccctttatgtatcgatttattcgccgcatctatgccgtcattcactgatttgacgactttgccggctgattccagcccttttttggctgtatcaacgacagcatggatcggttctttcagctttaaggctgctttttcagcaaaaccggctgtatatttggcgatttgttctccgacgactccgccaatgtatgaacctgctgccccaagaaggacagtacccacaggtcctgcaaagcttccgattgcaccgccgatgacagcaccagctgtggcaccgccggcaacaaaaatcgtattattcacagcattaccgacggccttggcgttttcacgcttgagaacttcgggtttgtcctggtattttgcataattttcagcaattttcacgcctgctccgaatgtttcggtcgcaccggtaatcagtgtggcggtaatggcatttcctttcgcgaatctcaagcccgtttttcccacatccttcaaagtggagcgtacgccggcttcattaagaaatccttttgtgtagcttctgacgctgtttgaaaaatccaccgtgtcctgagggaagtattttgtaaactttttatgtaccaaatctgaaaaaggacggtttgtctttttcaacaaatatttaggattcaaaagcactcttgccgctttttgataatgtgagctgtcaacggccctggaaatatccaagagcagttttgagtgctgtgctgtatgcaagccgcttggctgtttcacaaatttcgtaagccctaatccgtaatattttccctgcgtcagcataagggcggttaagcttgtcaacgtaccgtatttgtcgtaggcattgtagagctttcgcaaaatatcatcttgttccacaaatttatcgcccgtttttctgatgaaaatctcattgtcactcagcttggtgacgagcgcctttcctgagctccacgcatcgcccactccggaaaaacagctgctgtagcggggatcgcattgcaaaatcatctgccccagctccacatgcaggtccttatatttgttttccatatcagttaattcagtgactacatcatttgcaagctgttcgagcttatccggatcaactgcaatgtttcctgacacaccgttcacctcccgagtttatgtctttcctctcttgctttacgctccagttcttccattctggcaatttcagcttttcgttcttctattttgacagcggcagccttcagctcttggcttgtttcaagcagctcctgttcgaattgatcgtaggcggctttcgtttcctcgaaatcctggtcaaacgaatctcttgctttgccctgccaagcatctcccaatgcagataaccgggattcaagcagcattttggagcttctgacctcttctgcggccgcactatacttgtttgccagctcaatgactttatatgagtccaacttttgtcccctgccttttctaaattcacgcacaattggatgttttatataaatgattataaataattcggcatgtatccgaatcgtacaaaagaaccttttcataagaattggaagggcgtatattcacttaaaattcacagttggtgagactttaagattacaaaaaaggtaaagaaaggaatctgtaagagggagtcaacttaatattaggagtttctacgtttggaagacgaatgttttcgaggtaaccgtatataaaaaagagcctaaaataggctctaaacaaattgcgtattgcttactaatcattaaaaatagattttataatcttatttattgctaaataaacaaagaatataaacaagccactcatcacatacataattaccagtaaaatcaatttttgttttaatgtcatgtcggggactgctgagatcccgagtgtcatgccaatcataggaagcaaatagagaattaaaaagatttttttcttatatgtattccaagtgtttttcattgtctatctccttgttcttttaaaagcatcttattggtaactttataacctgtatagattgttacagtagtgatcaaatacaataaaaatagtaaaacgatccttataccgatttggatgccaggaagcataaaagtaattaatgtcatacaaatcatgaaaaacagataatatagtaaaatgaatggttttttatactttttccaaaatcgtactattaaatagttcattttattagcctttaagtgtttcttgaaaagctttttcttcttgtgtttgatatccctcaaaaagaacttcttctatcatatcgtgattgaagaacaaattataattttcattgatattaccttctggataaggaactgaaacataatcgtactttttttgtgaagaagtttgaagctgatttctcccataaatcattacagtttttcgtacatttaaaattttcaccacactaccgataggcagcaatgtattagacattaatttctcactctttctatattaattttttttcttaagcaggtgtggatgtttttttaaccagaatttttttctgaaaatatgtaagcataaaggtataagaaaagtgaatactgaaataataaaagtaattaaatatattacttcctgaggggtttcactatcaattaaccaatatagcatgaataaactaaagataccgaaaggaactggaaaaatagaacctattaatagtgcttcattaattttttttggtaaaaacccatttttttcactcatttatatacctcctagtcatctttttctgctccaaattttatccctaaaccaataccttctgcagcataaagttcattttcaagacctgtcttcacttctaccccgacgctgccaatagatgcagttaccccaaaatagggatcatattcaattccaaaccactcttcaagtggttcatagccgaaccaattaaatggatgtatggtaagctctgcatcagcaatacttgctgatgctcctataccaaccgagtaattttcaatgccagcttttgtttcaccatgaccaattttaaccttaaataaggctggagattttttatggtcaaagtttgcattaattatattagcttctgctgtaccgccaatcatctcaccagataaaaaagagtccgtaaaactttgtaaatatggtaatgacacttctatattaccttcagccattctaaagaataattctttagattctaacttttcttccttatatgcactatttgtatctatgagacttgcgccagctttaaaatttactttttgattgcttatatctatattggcatatccattaccgaaacctttataaatagctccgttaatttctttattcttagcatactttaaattgttaatggcatcaaaagtgttatatattttttgagtaatgccttcatcatcacttttatttttattaataccatgatctgcttcgctctttgaaccgatgttcttagttcctatcgaaggatcatctgaatttgaaataccgaaaaattcgataatttcttgctcatctttagcattaattttatctaacattttacacatcggagagtctttatctagttgtgcattgttaaaagcggtataactattattacttttcagtgaatcgttgctaaattcgggttttagtactgagccacttatataattattaatttcaattcgaggaccaccgtattttgcatcaagttgttttaaataatcttccattgtggtgatatcttgatcgattgaatctagagaactagtgttttcacgatcaaaggtatatagatgttccaatgtttcgtctatattactttcagccttttttattttttcgacaaaattttcgtcattcaaatctttgagacttacaatgtgtttaactttttcaatctcctcatttgctttatctgttagagatgttattgatctcttagtagctgttaacccattattcaaatcattctctaaaaaactttgcgaaataaaacctgtgtttgttggttctaatgaatataatgcactctttattttatttaatacttctttataatcactgattacacaagaataaaaaagaagaaagggagtgtgacattcactaaaaaatgttcgaatcgcagttccgccctctcctttaagggaatcatctaatgatgcaattccttgtgtacttttaattacatctgttaatttctcagcttgtttatctaattgttttatggtcttgtctatagagatgagaaatgaatgtacatcaagagttttcaaacaacgttccttccttctttacattatttattagttattgatttggaaagcacttcatctgtttcttgcatagacctaactaattgttctgtttgcgagatttgtttgtttaaggaagaagcatatttctcagtcagtttatttaatttgttattcagcgcattcagtttctttgtgacatcaaggttattgtggtctgttaaattagtaggaatagatactttaataacttcagttgcattttttaattttgtaattgctttttcaacttcaggtaaatcaaattttatttcattgcccatacaaactcttccttatcagtgtgaatttttatttttttgtttttctatttctttttgaatagaagtgatctgatttttcaacccatctatatcatcaattaatgtattaattttgtcttcaattttagttataacctcatctaattgtttaccttttaaatcttgatattctgagtttatctcgtctcgaataagttcgaatttatttgctaaacttccctgccatgtatccgaggacagagatggctcagttattttattttttgactccaaaaattcttgctggatatttgtcaagttagttttgcaagctttgagatcttctaaattctccttttttaaacttagttgtgtttttacaaaggataatcccaacatttcaccaaacaactgtaaacacctcattgtcacataatatgtaattcttttgaaccgttattaaaaacaaaagggagactttcctaatgttacatgatggtatgtaatggataaataggaaatatagattatataatgatttctttgttatgttggttttaaattaatggaggtgttaagtatgaataggcctattagatcagttgttttacctattgtaaggattccctgcaaatgagaaatttcccgctctatgggaaaaaacactaaagttgatcaaatgacctaagtgcgccaaacgtgttacgggacgagctatctcatggtataaatggaattgtaaacgttatcaaggaggtcgtcatatgaagaaaaaatcattctcaatcgtaatagcgggcggagggagcactttcactccagggatcgtactcatgctcttggaccatttggaggagtttccgatcagaaagctgaagctgtatgataatgataaggagagacaggatcgaattgcaggcgcctgtgacgtttttatcagagaaaaagcgccggatattgaatttgcagcgacgactgacccggaagaagcttttacagatgtcgattttgttatggcgcacatcagagtagggaaatacgcgatgcgtgcgcttgatgagcaaattccgttaaagtacggagttgtcggccaggagacgtgcgggccgggcgggatcgcatacggtatgcgttcgatcggcggtgtgcttgaaatattagattacatggaaaaatactcgcctgatgcgtggatgctcaattattccaatccggcggcaattgtggctgaagctacgagacgccttagaccgaattctaaaattctcaatatctgtgatatgccggttgggatcgaagaccggatggcgcaaattcttggcttatcctcaagaaaagaaatgaaggtccgctattacggattaaatcacttcggctggtggacatcaattcaggatcaagagggcaacgatttaatgccgaagctgaaggagcatgtatctcaatacggctatattccgaaaacagaggctgaagcggtggaagcgagctggaatgacacattcgccaaagcgcgtgacgtgcaggccgcagatcctgatacactgccgaatacgtatttgcaatattatttgttcccggatgatatggtgaaaaaatcaaatccgaatcatacgcgggcaaatgaagtgatggaagggcgcgaagcttttattttcagccaatgtgacatgattacacgtgagcagtccacagaaaacagcgaaatcaaaatcgatgaccacgcatcatatatcgttgatcttgcccgggcgattgcctacaacacaggtgaaagaatgctgttgatcgttgaaaataacggcgcaattgcgaactttgacccgactgcgatggtcgaggttccatgcattgtcggctcaaatgggcctgaaccgattaccgtcggcaccattccgcaattccaaaaagggcttatggagcagcaggtatccgttgagaagctgactgttgaagcgtgggcggagaaatcgttccaaaagctgtggcaggcgctaatcctgtcaaaaacagtgccgaacgcgcgtgtggcaagactcattctcgaggatttaatggaggccaacaaaggcttctggcctgagcttgatcaaagcccgacccgtatatcataactgaaattcccccattttcgaatctgtaattgtatataatagaaagaaaatggggggatctgatatgcagctcgaagaactgatcaatcagcactacagcaaattgaatgacaacgattttcatattttaaaatatatattgaatcataagcacacatgctatcaccttggaatcgacgcgctggccaaagcttgcagtgtatcgcgttcctcaattttacggcttgcccaaaagctcggtttcagcggttacagtgaatttcgcgtctttttaaagtgggaagatcagccggaagaaggcgagagtatgagttttgaaaagctgcttgatgatattgaagcaaatttgaagttcttaaggacaaaggacatgacggacatgtgccagctgattgatgaagctgaccgcattttcgtctacggttctggaaatgcgcaaaagatatgcgcccgcgacctgcaaagaatgtttattccgcgtcatcgctatcttattttgattgaagacacgaatgaatttaatctgatgcgcggggattttaaagtgaacgatctgtttatcatcatttctctttccggagaaacaccggagctgattcctcaggcaagaatgctttctgcaaagggtattccctttatttccattacgaatttaaaaaacaatgtcctcgcccagctgactccgcataatctttatgcgacaagcaaacctgtgacattaagcgataaaacggaaattgtcgcttttgcaccgttttttctcgttggcgaagcattgttccgcgcatatgttgattacaaagaggcagaaaaaaatgacaatgagtagcagggggttctggtatgatgcaaaaaattcagcgctttggaagcgcgatgtttgtgcctgttttattattcgcgttcgccggcattatcgtcggtataagcacgctctttaaaaataaaaccctcatgggaccgctcgccgatcctgacggtttttggtatcagtgctggtatatcattgagcagggcggctggactgtctttaaccaaatgccgctcttattcgccattggcatcccggttgctttggcgaagaaagctcaggcacgcgcttgtttggaagcgcttactgtctacctgacattcaactattttgtcagcgcgatattgatggtatggggaggagcatttggcgtcgacatgaatcaagaggtcggcggaacgagcgggttaacgatgattgcgggcataaaaacgctcgataccaacattatcggagccatctttatttcttcgattgtcgtctttttgcataatcgctattttgataaaaaactgcccgattttctcggcatctttcaaggctcaacatatatcgtgatgatttccttctttattatgatcccaattgccttggctgtgtcttatatttggccgatggttcaatcgggaatcggctcgcttcaaagcttcctggttgcttctggggcggtgggcgtttggatatacacgtttttggaacggattttaattccgaccggccttcatcactttatttacacgccgtttatttatggcccggctgtagcggaaggcgggatcgtcacgtattgggcacagcatctcggcgaatattcgcaaagcgccaaaccgctgaaggagctctttccgcaaggcggattcgcgcttcacggcaactcgaaaatcttcggtattccgggtatcgccctggctttttatgtgacagccaaaaaggaaaagaaaaaactcgtcgcagggctgctgattcctgtcacactgacagcgattgtcgccggtattacagagccaattgagtttacgttcttattcatttcacctttcttatttgcggttcacgccgtgcttgccgccacaatgtcgacagttatgtatatggccggcgtcgtcggaaatatgggaggcggactgattgaggcggtgaccttgaactggattccgctctttggcagccacggtatgacatatgtgtatcaaatttttatcgggctctcgtttacagcaatttattttttcgtcttcagatttttaatcctcaaattcaatatcgctacaccaggacgggaaaaggatgaacagcaggaaacaaagctatattcgaaaaaggaatacagagaacgaaaaaacaaggatgaaacggcctccgctgctgaaacggctgatgacaccgcttttctgtatattgaagcgctgggcggaaaagacaacatcactgaagtcacaaactgcgccacccgcctcagagtcagtgtcaaggatgaaacaaaggttgaacccgacagcgtattccgcgcgcttggcgcacacggcgttgtcaggaacgggaaggcgtttcaggtgattatcggattaagcgtaccgcagatgcgggagcgtgtggaaaaaatactaaatgaataggtgaaattatttgatcagtgcgctgtttaaagacagcgcttttttgtttgtcatacgtttgccacttataagtgcaagggatgttatgtttcttaaaaattgaaaccaatagggggagtaaaaatggaaaattatacaacgtttttaggtctttacaaacctgaaagcactgaaagtattgaaattgattccaagcttgccgagaatttcgaaacgattgatagtaaaattgggattgcattaagtaatggaataacaacttttgaaaacttaaatgaaagactcaaaatgtatgagaacagatttgagtaccttgatgaacgaaacgtaatggattatggagctaaaggagacggggtcacagatgatacgcaagcatttcatgatgcgatggccgaaggtggctatctcataaaagtccctgcaggcgtatttagggtatctggcttgctcgttccttcgaatacaatgctggttggagcgggtaaaaaaaggaccatcatcaagttattagacgatacgccagttggtcactctgtactcaccaatagtgatcatacaaatggtaatgaaaatatctacattggacatttgacactggactggaataaagatacgcgtcctgctggatggaagatccctaaggggcccacttcaagctgcttgctttttgcaaatgtggattactcttttgtagagcatgtttttgcaaaaaatgccggccttcacgggtttgatgctacaagccctaattataacagacacggagaaaatgatgatcctaccttttatcagcctggtggctgcaactttgtaaccttctcatattgcgaagcaacaggctctggcgatgataatttcacatgtcactttggaaagcatacgactttcagtcattgtctttcttaccatccgatggggttaaatgatgggtcttcaaatacaaactgttttgaaatcgatgatggctctcaggatgtaatggttgatagctgcatcgcaattggaggagttcgaggatttgaaattaaagctcatgattatgctccggccgcaaaaagagttcaacttgtgaactgccgcgcctatgaaaatgcaattagtttttgcattcggcatataggacaccacacagcaagtgatcctcaatcagcatcagctcatgacgttcagctggctaactgtatcgcatataaccctaagccgagtgatctgtacaaaggggcagggccgaatgcattgcaaatttcaggttacgatggcgtcaatgtggttaattttcatgctatatgcgatgattcctccattaactataagggaaattcagtcgtaagcgtgtattataaagggcgtctaatcaatttaaagaatataacgattcgaggatttaaaactgctgataatgatctttatattgtaggtggcgacaattctgtcggcaaggtaatgattgatggtgtgaccttgatcgattcagccgaaaagggtgttgtttttgggagcggtatgtacgagtctgtagttagtaatgtatgggggcaaagatcgcctaaaaataacagtggtacagttgggattttttctgttgaccctgatcttaatgtttctaattgtgacttttcaggctacgaaacagattttaagattggcggcgtcgtgacgccgtactttttgtttaaacataaaggaagcgggattattggctctcgtgattcccacgctactggaaataataattttgtagctggatctgttcgaagcagagcaactggggctgctcaatcttctgtgatagcctcatataatacgatcaatccgaactcagactcagttgctctaggatgggcaagtgggagcacaccatcctcatcaaacagaaagatagaatttcatgcaaaagatggaacgattaaggcttcaggcagcataaaaagttcccaaacgttctcggattacgctgaatattttgagagcctaagcggtgaaaaaattccggcaggaaccctagttactttggagggtgataaaattagacctgcaaaaaaaggtgactttatgcttggagttatttctgaaacagctggtgtgatacttggtgagtcaagcttccattggtctggaagatacctgaagaatgattttggcgggtatatttataaaaaacagaaaggtgccaatggccaaatcgtcatggcgcctatggaaaaccctgattataagccagataagaactatgcctctagggaagagagggatgaatggaatgttgtgggccttgtaggacaggtttatgtaagatgcgacagcacagtagaagccggagactttattcaagcgcataacaacggaattgctacaaaaacggtatctcctaaacaaaggtggcaggtcatgagagtcatcaaagagttcgacaaaagtaagggatatggagtggttttagtttttattcggtaacattaaaatgtacagattctaaatagagtgcttaacaatgcactctatttagagttttaattagattttagaaatttttcaccgcatttttatgagattatattcctcgcaaaaaggtcttcattttaaaatttatctttttcattattctacggttccagcaatcttcctaatttatctaagtctatccagcacctcaacttgagtagagtaaaatctttgatattttttaatgaacgcagatcagcagtgaatagctctcgaataaaagataaagtgattttggttatagataaattcagtgcttttctatgctttcataacacttcatgacagtaaaattctttcatcaagccctataaacaattaaaataaaaagtacatattgctaaaaggggtttggaggcttttacatgcaaaaggctttgtcgtttttaaaaccacattcattgctggcgggaattgctctgattcttatgctgacggagcttgcagttgaactgatgcagcctttattgattgcaaaaatcatcgacgatgggatattgaagccagatctgcggcatgtatggatatggggcacggtcatgatcgggctgaccgtgttatcctttgcggcggggatgctgaattccttttatgccgcccatgtcagccaaagcttttcctatgatacgagaaaagggctttttcaaaaaatccagtccttctcctattccacatttggacagttttcgtcctcttcttatattacaaggctgacgaacgacgtcacacaggttcaaaatatgatttttatgagtttgcggtttatgctgcgggctcccttaatgattgcaggcggcattgtgctatcgcttgccgttaatgtgaaactcggcttttttctgcttgtgaccattccgatcctgatcttgtttttgctatgggtattaaggaaaggcggggcactgttccgctcagtgcagaaaaggctggatcaagtgaacactatcatgcaggaaaatttaattgcaatcaagctgatcaaagcgctgcttcgcggcagccacgaagtcaaacgatttatcaaagccaacacaaggctgatggaaaaaacggtttcggcctttcagcttgtggaattcacgatgcctgtactgatgcttttgatgaatctctgcatccttttgattttgtgggcggggtcctacagtatcacgagcggaagcactcaggttggcgatgttgttgcgataattaactacgcaacacgaattacaggcgcgctttcgatgtttccatttttgattatgattttcaccagggcgaaagcttcaggggatagaatcggcgaggtgcttgaaacagaaggcgatgagcgggaggaaggcatcatatctgatcgtttgtcaggacggattgagtttcagcatgtatcctttcgctatcctgaaatggacagagaagcgctcagggatgtctcattttctgtaaaaccaagagaaacgatcgcgattctcggtgcgacgggctcgggcaagtccacgctttttcagctcattccgcggctttatcagccggattcaggccgcatttacatagataaaaagccggttcaagattttccggctgaagggctgcgcaggcaaattggatatgtacctcaggaagtcctcttgttttccggcacaatcaaagaaaacatcgcttggggcaaagaaaatgcttcactagatgaaataatggatgcggccaaacatgcgcaaattcatgaaacgattttgaagctcccaaatggatatgacacagttttggggcaaagaggcgtcaacctgtccggcggccaaaaacagcgaatttccattgcgcgggcactgattcgaaaaccggctatccttctattagatgacagcacaagcgcgcttgatctgcaaacggaggcgaagctgcttgaagcaatcagcacataccattgcacaactttgatcattacacaaaaaataaccacggcgatgaaagctgatcagattttgctgcttgaggacggcgaactgattgaaaaaggcactcatagtgagctgctttctgcatctcagttatacaagcgcatttacgagtcacaattcggaagggaggggagcgagtcatgctaaaagacatccgcaagcctttccaatatcccaaactgccaattgacaaaaaagaaggcgcgaaaaagcgggcgaaagcaaaggatacaaagggcacactgagacgaatctggtcttacttggctgaaagaaaaggactgctcatacttgtcatgctgatggttgtcatcagtgcgatattcgggctccttggcccctttgtgatcggaaaggccattgaccattttatcgtcgggaaaacggtcagcggcttgattcccgttttgcttcttctgctcgctatctatatcattcagtccctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacatcgaaaatgtcagttctaccttaaacacgtcagtcattcaaattttgtcaagcgtgatcacctttgtcgggacgattgcggtgatgctgtacatgagcccgctccttacattgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaatttctcgaaaaaaacgctgcactcaagacgtcgggcttttgggcgcagacgatttccgggtttatcccgaaggtcatgaactctttgaataacttaagctttacaatgatagcggcaatcggcggtttgtttgcgctgaaaggctggatctcgatcggctccatcgtcgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacgctgaagcatttacagtttaccgtgcctgccgggcagtccatcgcgtttgtcgggccgacgggggcggggaagacaaccgtcactaaccttctcgcccgtttttacgagcctaacgaaggaaaaattttaatcgacggtacagatattaaaacccttactagagcaagcctcagaaaaaacatggggtttgttcttcaggattctttcttatttcagggaacgatcagagaaaacattcgctatggcaggctcgatgcttctgatcaggaagtcgaagccgctgcaaaaacagcgaatgcccatagttttattgaaaggctaccaaaagggtatgacaccgtgctgacgcaaaacggttcgggcatcagtcaaggacagaagcagttgatttctatagcgcgggcggtgcttgccgatccggttcttctcattttggatgaagcgacaagcaacattgataccgtaacagaagtcaacattcaagaagcgctcgcccgtttaatggaaggaagaacaagcgtcatcattgcccacaggctgaacaccattcaaagagcggaccagattgtggtgctaaaagacggtgaaatgattgaaaaaggcagccatgacgagctgattcggcaaaaaggattttacggtgacttatatgaaagccaatttgagaaatagacctttgtcctgcacagaggtcttttttgttacagatttatagtacttttatttcattttcgtaaaatgtaacaaaattacttgacgtaaacaagttatgtatatatactagcttacattaagtaagtgataacatttatcaaggaggataaaatgaataaatcatttgaaattggcacattacttttaagagttattacaggtattatcttttttgttcacggtttatcaaagtttcagggaatggagggcaccatccaatttttcggcagcataggccttccaagctttatggcgtatgtcatcgcagcgattgaactcattggcggagtgctggtcttcttcggattggctacacgtattgtcggtgtactgttcgctcttacactgatcggcgccatcatcactgttaagctgaaagcgccattcatgggcaatgcagaatttgattaccttctgcttttgacatccattcacctggcgcttactggaagtcgattcctggcgctggacccatttgtgtttaaaggaaaaaagaacggaaacgtttcagcataagaaaagaggcatgcagcatgaccagcattcatgaggatacacacattggctatgccaaactcacaattcgcagtctggagcgttcgcttcagttctactgtaacgtcatcggttttcaagtcttaaaaaagacggatcgccaagctgaattaacggctgacgggaaacgcgtactgcttattcttgaagaaaatccgagcgctgtcgtcttgcctgaacggtctgtgacaggcctttatcactttgcgattcttcttccggacaggaaggaacttgggatcgcgctcgcccgcttgattgaacacggcattgctatcggacatggggaccatgctgtcagcgaagcgctctacctgtctgatcctgacggaaacggcattgaaatgtatgctgaccgcccccgcagcacgtggcagcgtgatctggaaggaaactatgtcatgacgacaaccgctgttgacattgagggccttctggaagaggcaggagatgagcggaaaacatcgcttccgaacgatacaatcatcggacacattcatctgcatgtcagtgatttgaaagaagcaaaggcgttttatacagatgtactgggctttgacattgtcggaaactatgcgggcatgtccgccctcttcgtttcagccggggggtaccaccatcatatcggcttaaacatttgggcgggaagaaatgcgccgcctaaaccgacaaatgccagcggactagactattacactgttgtcctgcctcaccaagaggagctggttttagtggcgaaccgagtcaaacatgccgggtattcgattgaagagacggaaaacagttttcgtgtgaaagaccctgtttccggcgcctatattacatttgtgatttaactgcaatccccttgccgaaaaaacggcagagggattttttattttccagaaactcctgtcaaaaatgccctcaggcaggtatgataagaagggaattgggcatcgggagtgatgagcgtgaaggctcttttttttactaggattttcaccttaatggtaagctgttcggtttatttttttcttgtagaggatgacagctggtttgagtatttgttcatcgctggcggtgcgagtgtattcttagcaaatcatctcttattaagggtacagaaatatgcaattattttttgtctaattgatattgcagttggcttttcgttcggtttcatgtttccgggtacaggtttatatattacattgctcagcccggttgctgttaccttttttctgaagggatttgaccgaaaaacggtatggtctgtcctgtgtttttgttttatgatgtggctgattgttctattacgcacatatcatatgcttggtgatgaatatgtgatggatcattgcatcagcatgacattcgttgtcttctgcggtgtcgtgggcaaattaatccgcaagctgttggaggctcaggatacggcaaaacagcagtttcaggaactgacggagtcccatctggcgctgtctgccgcacatcaggagctccatttatatgcgaagcaagttgaagagctgactgccatttacgagcggaacagaatggcgcgggaaatccatgatacagtggggcataaaatgacggcccttcttgtccagctgcagcttttgcgtgaatggcaaaaaagagacagccaaaaagcggatgagacagtaggtgtctgtgaaacacttgcccgtgaagcgcttgatgatgtccgcttatcagtacgcactctgcaaactgaaaacgatccttcgctaatcgaatcgctgaaacagctgacagaggacttttgcaaaaatgcaggagtcacaacagaatttgcggtcagcggtgatccagcaatcatcccgctgtctctccatccgaccctgatcagaacggtgcaggaagcactgaccaatgccaaacggcacggcggcgccacagcctgttcgatacagcttgcctgcacaacggacagcatcagccttgtcattaaggatgacggcaaaggcaatcccgaggcagcacttggttttggtctcttgaatatgaaaaagcgggcagcggaacatggcggaatgatccgctttgaaagcgaacaggatcaaggatttactgtgaatgcagaattttcacttgccaataaaaaatggagcttcaggcccgtgcagcaaaaggagagtttatcatgattaagatcatcattaccgacgatcaggatatcgtcagagaagggctggcatccctgctccagctccgagaagagctcgatgtgatcgcaacggcgcgaaacggacaggaagccttcgaaaaggcgaaagagctggagccggatatcgtgttaatggacatccgcatgccggtttccaacggggtggagggaacaaaattaatcacaagctcgctgccaggcgtaaaggttttgatgctgacaacctttaaggattcagcgctgattgctgaagcgcttgaagaaggagcaagcgggtacctgctgaaggatatgtcggcagatacgattgtaaaagcggtgatgactgttcattctggcggaatggtgcttccgccggaattgactgctcaaatgctgaatgaatggaagcgtgaaaaacagctgaaaggaataaatgagatagaaaaacctaaggagctgctcgacctgaccgagcgcgaaatcgaagttctggctgagctggggtacgggctgaataacaaagaaattgccgaaaagctttacattacagaaggcacagtcaaaaaccacgtttcaaatattatcagcaagctggctgtcagggacagaacccaagccgccatttactcggtcagatatggtgtatctgtcttttgacatatgacgttttgcatatacgcttctctgaaaaggccttttacaggcctttttttcatgccctatgttctatctgccgctacatgccgcacgcctttctttcttctacaatggcaatggatcaaaaaaggagtgagacgacgtgctgcaagcagaaaatatcaaaaaggcatatgggaaaaaaacaatcgtgaaaggtatttctttttccctccaaaagggggagtcgttcggtctgctcgggccaaacggtgcggggaagtccacaaccatctcgatgatttccggccttgtgccgcatgacagcgggaacatcacggtgggcggctatgtcatcggaaaagaaacggccaaagcgaaacaaaaaatcggcattgttccgcaggaaattgcattatatccgacgctgacggctcatgagaatcttatgttttgggggaaaatgtacggacttacgcatggtgaggccaaaaaaagatcggcagaggtccttgaatatgtcggtctggctgagcgggctaaagataagattgaaacattctccggggggatgaaacgaagaatcaacatcggtgcggctttaatgcataagcccgagctgctgattatggatgaacctactgtcggtattgaccctcaatcgagaaatcacattttagaaacggttaaacagctcaacgaaacgggcatgacggtgatctatacgagtcattacatggaagaagttgagtttttatgcgacaggatcgggataattgatcagggggaaatgattgcgattggcacaaaaactgatttgtgcagccgccttgggggcgataccatcattcagctcacggtcagcgggatcgatgaagcgtttcttttggcgatccgttccctggctcatgtgaatgatgtaacagtccaagagtcagagctcaaaattgacatttctgcggcccatcatgagaaagtcgtcacaagtctgcttgctgaagccgctgctcatcatataagcctgctgtctcttcaggtgcaggaaccgaatctggagcgactgtttctgaatctgaccggccgcacgttgcgggattgatgagggacggccatgaaaaaaagcatatggatcgcatggaaagatgtgaaaatcagaatcacggacagaaaagggtttatgatgcttatcctaatgccgctcatcctaacctgtattttaggcgcagcgctcggatcagttgttgacggaggcagccggattgatgacatcaaagtcggctacattcaatcagaccagtcagatgcagcaaacatgtttacaaaagatgttctcaaaaaaatgaagtcgataaaggtcacaaaagccggcagcgaagacaagatgaaaaaactgcttgatgaaaagaaaatcgatgtaggtatcgtcatccccaaaaattgggaagccggcaaaacctcagctgttgtttatgccgctcctgatcaaacattgaaaacttccatcatcgaaacagctgcaagctcttttatagagcaatataaagcggtaaaggaagccgcgtcagcctcaatggactacatcagcaaaacggaagctgtaaagcaaggaaaacttgaccctgcacagtttgcagaaaagctggtaaagacgcttgaaaaagaaacaggtgacaagctgactattgcagaaaaatctgtcggcagcaaggccgttaccagttttcaatactattcggcggcaatgctttgcatgtttatgctgtttcatatgacagtcggggcgaaatcgtttttacaggaaaaggatacggagacgcttgccagaatgctgatgacgcctgcgcaaaaatccgtcattctcttcggaaaatggtttgggacgtatctgtttgccatcatacaatttttcatatttctgatcgtcacaatcaatgtatttggtgtggactggggcggtaatctgcttttcgtgagtgtactcgggctttcttacgccgcagctgtatctggtatttcaatgctgcttgcgtcgtgcatcagcgatatgaaaactgcagatgcgataggcggcttcggcattcaattgcttgcggttctcggcgggtccatgctgccgctgtaccaatttccggacgtcttgcagtctgtatccaaagcggtgccaaatcgctgggcgcttgacggctttctttctttaatggaagggggaggctgggctgaccttcaaaagcctgtgcttctttttgcggcgatcggcttttgttcacttgtaattggtatcagacggcttcatacaagataaggaggtacaaaaggtgaaaaaaattctagccatttgcggcattgagctttctctcatttttaagaagccacagaactatttgatcatgtttgctgccccgcttttgcttacctttgtatttgggagtatgctcagcggcaatgatgataaggtgcggcttgcaatcgttgatcagaacgatacgattctctcacagcattatattcggcagctgaaggcacacgatgatatgtatgtattcgaaaacatgtctgaaagcaaagcgtcagaaaagctgaaacaaaagaaaattgccgggatcatcgtcatttcccgctcgttccagacacagctggaaaaagacaaacatcctgaactgattttccgtcacggccctgagctgtcggaagcgccgatggtcaaacaatatgcagaaagcacattggcaacgctcaatattcaggtgaccgcggcaaaaacggcatcgcagacagctggagagaactggaaggctgcgtataaaaccgttttcgccaaaaaacatgaagatacagttccggctgtaacacgacagacgctcagtgataaaaaagagggtgcggaagcaagtgacacagcctccagagcagcagggttttccatcctgtttgtcatgctgaccatgatgggagcggctggaaccattttagaagcaagaaaaaacggcgtatggtccagattgcttacagcctctgtcagccgagccgaaatcggtgctgggtatgtgctgtccttctttgtcattggctggattcaatttggcatattgcttctcgcaacccattggctgtttggcatcaactgggggaatccggctgcagttattgtattagtgtcactttttctattgaccgttgtcggcattggattgatgattgcggccaatgtcagaacgccagaacagcagcttgcgttcggcaacttgtttgtcatcgcaacatgtatggttagcgggatgtattggccgatcgacattgaaccgaaatttatgcaatccatcgctcaatttcttccgcaaaagtgggcgatgagcgggctgacggagattatcgctaacggtgcccgcgtcacagatattctcggaatctgcggcatcttgcttgcttttgcagcaatcactttcgcagcggggctgaaagcgctccgagcctaaaaaacatctgccgtttaggcagatgtttttttgcatgtgggtacattcgtatgggtgcagcctgaactgcggttaatccttatctatcatagctaaaattgattccagccaagaaacgtaatttttctcccgctccagcgctttcgtcagcacaagatagtggccgaagtccggtgaagaaaatgacatcggctctgctgaagccataagcttttcatagcttccctgtaagtcagaaagcttggcctggcgtttttgcagctggtctttgaacaaatcagaagcctcctggcgcgatagacaagaaatgaaataagccttcagcataaattcatccttcaccgtctcgggtatcggctggtggcggatcagccagtcatgcagctcctgctttccgctgtctgtcagggtgtacatctttttctccagctttgtgccctgaatcgttgtccggaacgtgataaatccttcatccgtcagctttttgagctcagggtaaatctggctgtgcttggcgctccaaaactggccgagctcctctttaaaataactcgtaatatcgtatccactcaattcgccttttcgcaaaagccctaatatggcgtattttaatactctcatgctatcctccgtgtctggctgtttcgcaaaacagatgagccggtgctcaactgtgattctaactgcctattccccttattatagaaaagggaggaagggaacacaaccgggctctttggaaatgaagataaaaggtttgtcagaaggtatccgatttatctccgtcaatataaaagagatttaaatttaattttcagaaaaaatattaaccatattgattttttatgtataataggaaattggtggtataaacattttaagggggaataaacgtgaaaaaagtacttatggcattcattatttgtttatcgctgattctatctgttttagccgctccgccgtctggcgcaaaagctgaatcagtacataatcctgtcgttcttgttcatggaataagtggtgcatcatacaactttttcgctattaaaaactacttaatttctcaaggctggcaaagcaacaaactgtacgcaattgatttttatgataaaacaggaaataacctaaataacggcccgcagcttgcttcatatgttgaccgtgttttaaaagagacgggggcaaaaaaagtagatattgtggctcatagtatgggaggcgccaatacgctgtactatattaaatatttaggcgggggcaataagattcaaaatgtcgtaacgcttggcggggctaatggtttagtgtcatcaacggcgctgccgggtacagatcctaatcaaaagatcctctatacatctatttacagtctcaatgatcaaattgtaatcaatagcttgtctcggttacaaggagcgcgaaacatccagctttatggcatcggtcatattggcttgctctctaatagccaagtgaacggatatatcaaagaagggctgaatggcggaggcctcaatacaaattaatatcttcataaaaaacctgcagtctccgttacggcaggttttttgcatttttctagcaatctcgtctgagaaagatacaccaataagccagaggggtttatgaccttagtctatcatgcatacgtcaatttatgacatcaggcactttttcaaatagagcggacatgttaaggtacaaccatcgatttctatcaatttgaaataaaaggagcgctgttatgcaaattaaagaaatttttatgatccgctgcatttcgtgcttaagtgtcgtcttgctccatatcatttcaatggtcctgatgcttcaggcagaagctcttgcagatatttctcacactgttgattctttccgaacactcctgatgttcagcacgcccgcttttattttcatctctgaatttttactggcccgttcttatcctgatggggtgcctgacggttttttaaagaagcggggaaaagtgatttttgttccttttttatttatcgcggccatcgatgcgctgctgatgaccagtgcgatggggggagaggtaacctttctcgcgtttgtgcaaaaatatctggcgaacgtattcttaggaaactttatcggatacttcattctcgtcatctttcaattttacatgctgcatatgatgtttcatgagtatttgaaaaaagcatcgccgaaatgggtgctgtctatctcatttgtggtgacagccgcttatttaggctatttctccgcagccagcccggctcctgcttctgaagagggcggggcatttccgttcttctgggttccgttcgcaggctggcttttctacttttgtctagcctactattgcggaaaagaatacaagcgttttttagcgctgctgaaccaataccgctgggtggtgtacggcgccgcaattgcttctggggcgctggttgtcactgtttcatatgtcggtgaaatcggcatgatcagctcgaagcggcctgatatcatgctgtattcaacaagcatgattttcctgtgctttcacttgttttccaaaatgaagcatgtgccgaaaatcatgatgtttattagcaactattccttttcgatttatctgcttcatgcttattttatgattataggctacgtgttgcttttgaatatgcccgaaattcccgccgtaccggctgttctcctgctgtttgccgtgtgcacagccggcccgattctgacctcgtgggcactgaataaattcaaatacggatatttatttgtggggaaaatttatcagccgaaacagaagaaggtaacagtcgaagtgcgtgatcacgcagggtgaaaaacaagcggcaggagggctcctgccgcgtttctttacttctcatccgcttgcagaactgtttttaaatatagttttgcagactcagcaagtccagatacatcagctttttcttcatcgaaatacagggcgttttgaatgatgccgtcattcatattgaggaaaaacttggcgatagtcgcaagaggctgaagcggctgaaactctccctgatcgatccctttttgcaatagctttgaaaatctttccacaaaaagatcataccttttctccaaatactgcctacgttcctcattccgccaagctgtcactaaatattcaaattgcaccggcgccagcgtatctgctacatcacgcaggccctcagtcagttcatccaaatagattgaaatggcggaccaaacactttggtgttcagctgattgatcaagctttcggagtccttcatccagccctgtttcaataatgcggcgaaacatctcctcagtgcttgaaaaataaagatagacaccgccccggctgaaacctgactcttctacaacgtccttcatcgtcgttaattcgaatcctttacgtttaaaaaccgttttggcagcctctaaaatctttgcctgtcgtttatccttgtgctcctttgttacttttggtgacaagatatcgcctgctttctgaaactttcttacctacaagtgtaatcaacccaatcaagatcagcaagcagccacagacaagaaaagcaagtgaaacaccgatccattccgccagcatgcctccgcccgccatgccgaggatggaggcgagggttgtcgcgctctgaatggcgccaaacaccctgccgctgtaatcaaccggcactgttgtttgcacgagaatttgaaatggaatatggaccagaccaaaagccgctcccatgatgaaaaaagcgaaaataaaaagagcaatgccggcaattcccattccgctcagaaatggcacgcctccagttgctagtccaagcagaaaggtcccagctgagaaataaagaaaataagaggtgattcgccgtctgccggcaattgccgccgtaaggagcatgccggctccgctgacggccatgcaccagcctgcaagctcaggcggagcgcctgaaaaagaacggataagaatgatagcctgggaatcaccaatctgcaaaacaaagagaacgacgcaagctgtgagtaagcctgttaatagaagcggcatccgtttcaaaaactgaaggccttccttgatagaagtaagtgctggtgttttttcttgaggtgtattggctttttgtaaaaaagcatctctgggaaggaaaaacaaaatgacagcggaaagaaagaaggcgccggcgtttatataaaaaacagagtgtatcgagaaagcagcgatcagtgtgccgccaagggcagggccgaagatttttgagctgttatcaatgatgctgctgacggaaacggcctgctgaatgtgtgcttccggagccaattccttaagctttccgtttttagcaggtaaaaaaagtgaagaaaaacagctctgaacggatagcaatacgtaaagctgccaaagctcactgacataaacgcagctgataacagtgagggcacggccgatttcagatagaaacataatcgtttttctgtcaaaacggtcggcaagcaggcccgatacaggtccaagtacaatgacaggcaaagcaaatgacatcattaaaagcgacatatctaatggtgaagcatccagctgaaaagcggctaaggttagcacggccaaaatgtgaaaccagtctccaagtgaagaaatggtttgcgaggctaacagtgtcatcagccctttttgagtgcaaaacaacggtttttccatgattcatcctcctaaataataaaaatgacacgagtgtcgtttttattgtatgggaaaaagacgcaatacacaatctttttcttgtaaaataaaggagaagagtgaatagaagggagaacattcatgacatcagtcaatctaagctacccaataggagaatacaagccgagggaatccatatcgaaggagcaaaaagataaatggattcaagtgcttgaagaagtgccggcaaaattgaagcaagctgtagagggcatgacggacagccagcttgacacaccgtaccgggacggtggatggaccgttcggcaagttattcatcatctggctgacagtcatatgaacagctatattcgttttaaattgagcttgacggaagagacaccggctatccgtccgtatgatgaaaaagcatggtcggagctaaaagactcgaaaacggcagatccgagcggctcactttcgcttttgcaggagcttcacggaagatggacggctctgctccgcaccctgacggatcagcaatttaagcgcggattttatcaccctgatacaaaggagatcattaccctggagaacgcgctcggcctgtatgtctggcactcacatcaccatatcgctcatattacggagctttccagacggatggggtggtcttaacgcttttgccggcggaaagccggaatactgatagcagcaatcaccagaagtgagatcacagcagccgctgcatataaatgatcatagccgctggcgacactcgcatgaatggcgtcgcttatcgcggttttgacttcaggaacgggaatgcgttcgatttgttcttgtaaagaagaaacatcagaactgtcgatctccggaatcatctgcatcgccttttctgaatatccgctgtccgataagcggctgctgatctcatcacctatttggtcaaacccggctgtgataaaacctgcataaagagtaggcgccaaggtcagtccaatttgtcttactaatgaaagcgtgccaagagctgtacccttatttgtttttgccgcttctgatacaaggacgttcagcggagcgcctaacagaaagccaaaaccgatgccagcgactacactagcgatcacaaactcccatttttccgtcacccagagcggaaataaagcaaaccccgcacatgagatgattcccgaaagaataacggtttttacaggaccttttttgtcggtaagcgctccgccaagccaagcgccgattccggaagccaacgcaagcggtgtcatccaatagcctgcttttgcggcagggacacccaaatactgctcgacatatgatgggataaaaatgactgccgccaagagccccccggataacaaaccgatgataagcgtgcgctgaaacatatggtttcgcagcagagaatacgccaaaatgggatcgcctcctcgcatttcaactctcttttcatacgagataagcgctgcaaaacaaagtatgccaaaaataatacatccataaacctccggattccccaagctgtgtaagagatttgccccgtcaaggttcgtcatgccgtacatcacggctaaaatcgacagggatagaaggaagattccggccgtgtcgaggcgcttagcttcaggtgcttttgtttccgcgataaagtatgcgccgaaaacaaccaatagcacggcaatgggcaaattaatcaaaaacagccaatgccaagacccggtccaatcaagcagaaagcttccgatatttggcccgagcacagcggccatcccgttcattgcgccaagcagcccaagggccttcccctgtttttcctttgggagagtcgcgagaatgtgagagctgccgatgatgaaaatcccgccgcctccaagcgcctgaatcagccgcgatatcagaaagagcgggaagctttggctcaaagcaacaagcaaagaaccaagtccgaacaggcaaacctcaatgagaaagagtttttttctgccgtagcggtcggaaagctttccgacgattggcacactgacgctaagaccaagcgtataaagggtaatgccccatgatccccaggaaggagagacggaaaacgactcgtttatcgttgttaaggcagctgaaataattccgttatctagcgcagccataaatacaccaatcgtaaacaggctgatcgcccacttttggcctttctgctctgttaatgcttcagacatattcatcaactccttttttattcattcaaagtatattattcattttaaatgaactaaatgtcaaataaaaaaagcctgctcccgcagtttgcggatgacagacttacagatttattcttttttcgctttctctaatgctcttgaaaggatagacagcccttcggaaacagcctgcttttcttcaggggacagcagctctaatgaacgcttcaatttcaggtggcctttttcatacaaaccccggaaaatctttttcgcattctctgtcaactgaacaactacagagcggcggtcctcttcagaatgtgagcgtttgacaaatcctgatttttcaagccggtcaagcagcccagttgtattggacagggaagcccccattttttcagcaatgtcgctcactttcaatgttccatggttgtttaatagcatcagcaccttcatttgcggcatgctcatatccagcttcatccactcggacacatcaccgagcccggcggacgttaagactttcatatagagcacccatatttcccgttcctccgatgaaagaatgttttcgtttaagactgttgtatcgtgtaaattatattccatttcatcacttcctcatcattcactcctcttaccatattactcgattttcactccagaaagaaagtgagcagaaaccgcatgcgggactttgtccgaaaaataacggtagtgtataatgagttggagattattgggggagaggatcgaactagaatatgattggagagaccattgctgattaaaaagaatgctttatcaatattaaaaatcgtttttcctattgctgttttgctatttgttatttatcaatcgaaaaaagaactgacaaatctgtctttcaaacgtacgctcatggtcatcaacggactggaacgaacggacttattcatgcttgtgttgatcggcttgctggctgttgcggccatgtcgctgtatgattacgtcctgaaatactcactgcgcctatcgatcacaaacggaaaagtattcagggtttcctggatcgccaattcatttaataatgtgctgggcttcggcggtttagccggcgtcgggttaagaatgatgttctataaggagcatacgaaagaccataaggcactcgtgaaaggaatcgcctggctcacatcatctatgctgctcggattatctgttttcagcattttcgtcgctgcgagagtgctgccagtggatgaagtgattcatgaaaagccttggctatgggcggtcgttatcggttttgcgctgatattgccgctgtctttggcggtgtccaaaataaaagaccgcaaagctggggacgaagagaatgcggataaagtgaaaaatccgattttcgcatatattggagcttcagttgttgaatggctcatggccgggatcgtcatctattttgctttgttcgctatgggcattcatgcagatatcaggtatgtgttcggggtgttcgtcattgcggcgatcggaggaatgatcagcctcgtgccgggcggcttcggctcgtttgaccttttatttttgctggggatggagcagcttggctatcatcaggaggccatcgttacttctattgtgttgtacaggctcgcctactcatttatcccatttatcttggggctgttctttgccgccggcgacctgacggaaaatacaatgaagcggctcgaaacgaacccgcgcatcgcaccggcaattgagacgacaaacgttctgcttgttgttcagcgtgcggtattagtgagaattttgcaaggctcgctttcccttattgtgttcgtagcaggtctgattgtcttggcctctgtttccttgccgattgacaggctgacggttataccgcacattccgcgcccggcgcttttgctgttcaacggcctgtccttaagctcagcactcattctgctaattttgccgatcgagctttataaacggacaaaacgttcctacacgatggccattacagcgcttgtcggcggctttgtgttcagctttttaaaagggcttaacatcagcgcgatattcgtactgccgatgattatcgtattgcttgtgctattgaaaaaacaatttgtccgcgaacaggcatcctatacactgggacaattgatattcgctgtggcgctgtttactgtggcgctctttaactacaatctgatcgcgggctttatttgggaccggatgaagaaggtgctgcgtcacgaatatttcgtccacagcacctcgcatattacacatgcaaccatcatggcgatcatcattgtgccgctgttcttcttgatatttacagtggtctatcataagagaacgaaaccgatcggagagcaagctgaccctgagcgtcttgctgcgtttctcaatgaaaaaggcggcaacgcgctgagccatcttggttttcttggagataagcggttttatttttctagtgatggaaatgcactgcttctgtttgggaaaatcgccagaaggctggtcgtgctcggcgatccatctggccaaagagaatcattcccgctcgtgctggaagaatttctgaacgaagcgcatcagaagggattcagtgttttgttctatcaaattgaacgagaggacatggcgctgtatcacgattttggctacaacttctttaaacttggcgaggaagcatatgtagatttaaatacattcaccttgactgggaagaaaaaagccggccttcgggcaatcaataaccgctttgagcgggaggagtatactttccatgtggatcatcccccattttctgatgcgtttttggaggagctgaagcaaatctcagacgaatggctcggctcgaaaaaggagaagggattctcgctcggattttttgatccttcctatttacagaaagcgccgatcgcctatatgaaaaatgcagagggagagatcgttgcattcgcaaatgtcatgccgatgtaccaggagggagagatatcggttgacctaatgcgctatcgcggcgacgctccaaatggcattatggacgcattgtttatccgtatgtttttatgggcaaaggaagagggctgcacgtcatttaatatggggatggcacccttggctaatgtcggcactgcctttacatccttctggtccgaaaggtttgccgctgtcatttttaataatgtcagatacatgtacagcttcagcggcctaagagcctttaaagaaaaatacaaaccggagtggcgagggaaatacttagcgtatcggaaaaacagatctctttctgtcaccatgttcctcgttacacgtctgattggcaaaagcaaaaaagactccgtctaataagacggagtcttttttttatttcgtttttaagaagtaggtttcaatatcatcaagcaggtagtttgcggctttaattccgcctgcggttgtccatacgacgtcatcgacttcatgcgcattacctgatttcacggcctttaggtttttccatagtgaactgcttgtccactgattggcccatttttcattttcctttgcattatcggctttataagtgaaataaaacagcacatcagcatccatatcaggaatagattctttactgtcagttgagaacgtaaattggtccttttgtttcttgaacagttctacttgtttttcagggcgtttgaagccaagctggtctaaaataatccctgagaatgaatcggtataatagattcttgattcaccggataaaaagcgtacgactgaaacggttttgtttgtctggtcgcccagcttgttttttaaatcagaaacacgtttatcaaaatcggcaatgacttccttgcctttgtccgccttattcaccgcgttggcgtatagagtcaggttatccttccagttcccggccaaagattcagcaaaaacagtcggcgcaatcgcatttaactgatcataaattttttcctggcgcactttgtttccaataatcaaatcaggctttaattctgcgatggcttccacattcggttccgtttcaagaccgacgtttttaacacctttcatgtcatctttcagatagtcataccacgggtcgcccttccatgactttacggctccgaccggcttaatgccaagcgctaagagcgcctctgttccttcattagttaaaacaacaatccgttttggattggcggggatgttgtctgatgtccccattgcatgtttgaccgttcttgttttgctgcttgacccctcgctgttgcttgaactttctgaactattacaggcagaaagtaccataacggccattaaaaatacgaatagcatgctgatatgctttttcatctttttcctcccaatattgaaattcattatcatttagatcataataagcagtgttaagagtgtcaatccctaattgaggattattctcaaaaacaaacattacatagtaaataactaggagaattagatcatgatctgcaaaaaggcatcttcaaaatggattgtgttagtatgtctgattttcattttactggcggctgtctgcgcaagcgtcgtgtatggctatacaggtacgtcatggagacaggtctatcaggcgtttacttccttcaatggaacaaatgagcatgtcatcatcaaggatgtcaggcttccgcgcgctttggttgcgacagtcgtcggcgcctcgcttgcagccgcgggcgctctcatgcaggcgctcacaaaaaatccgcttgcgtcaccggggattttcgggattaacgccggtgcaggtttttttattgttgccggatcgttttttctgcatattcagtcacctcaggcattagtatggagctcgtttctgggggcagcatttaccgccgcgatcgtctatgcagcaggctcgcttgggagggaagggctgacgccaatcaaactgacgctggcgggagctgccatggcagccatgttttcttctctgacacagggcttgctgtctgtcaacgaactcgagcttgcccaggtgcttttttggctgactggctctgtgcagggccggagtctggatctgttgatgacgatgtttccatatgcagcggcagcgctggtaatctgcttctttctcggccaaaaaattaatctcctcgttatgggagaagatgtggcaaaaggactcggccaaaaaacaggcctgctgaaatttgtgatggcgctttgtgttgtcatgcttgcagggtccgctgtcgccattgccgggccgatttcttttatcggcatcattattccgcattttgcccgctttgtcgttggtaatgattatcgctgggttctgccattttccgctgttttgggtgccattttgcttgtttgcgcggatatcggtgcgcgatatatcattatgcctcaggaagttcctgtcggggtcatgaccgccatcatcggaatgcctgtgtttgtgtacatcgcaagaaggggggcgaagctatgaaacttcgttttggcgttactgcggctgaaaagaaagcatggatcgtctttttaattttactggggttaacagctgctgtactcatcataagcgcaggtctcggacaaaggtttattcctccctgggatgtagcaaaaacattctttggtgcaggttccaagctggatgaactgatgatcatgtcgttccgcatgccaagaattttgacggctttatgcgccggtgtctgcttggcagcggcaggcgcgatattgcaggggctcgtcagaaaccctctcgcatctccggatattatcggaataacaggaggagcggcggtagcggtcgtgcttttaatgatgttcttctcagaccgcagcagttcacttacgatcagtctgtcatggcttccagcagccgcatttatcggcgcatcggctgtcgggctcatcgtctatttactggcatacaaaaatggcgcctccacatttcggctggtgcttatcggaatcggattttcaatgtcggcgcaggcgatgactaccctgttgatgatcaaaggcccgatttaccgggcatcacaagccaatgtatatatcactgggtcagtttatgggtcaaactggcagcatgtaaaaatagctattatcttatctgtcattctcttattcatttgttttgtcgcgctaaaaaatatgaatatacaggtgctgggtgaagatattgcggcgggtgcaggaagcgctgttcagcgaaatcgttttttcttgctacttttgagtacggctcttactggttgtgcagtttcagttgctggcacaatcggttttgtcgggctgatggcgccccatattgcaagacggcttgtcggctcatcttatggcgcgctgctcccagcgtcggcacttattggagctctgctcgttttaacagctgatatcgtcggcagaaccttatttgctccggtggaagtgccggccggcgtctttacagcggctatcggcgcaccttattttatttatttgctctataaaacaagaaattcttgatcgttacacccattttcttaaaaaagaaaatgggtttttttgataatgactgaagattcgtaattatttttgctatactgacagagacattgataaagaaagggcggcagatgaatgaaagaagcagaggtattaaaatatgaagcatttacaagcaatcccggcaaaggaaaccccgcaggcgtcgttttgcagggagacgtttatacggaagacgagatgcagatcatagctgagcgtgccgggtattcagaaacctcctttatccgaaaaagcgagtcggccgatcttgaactccgttactttacacctggacacgaaatgaatttgtgcggtcatgcgacagttgcgtctctttacgcattatgtgagaaagaaatgctggagagcggtaaaacgtacagcatccaaacgaaagcgggtatcctgcctgtgaagatttctgaaaaagatggccgtattcatatcacgcttgaacaggcctctccgcaattcaaaccatttacaggcgatcggggaaaacttgcgaacgcactgggtatcaccgatgaagattttcatgaagaccttccgattgtgtttggcagcactggtatatggacagccatcgttccgcttaaatcattggaggcttccaaaaaaatggtgccagataacaatcaatttccggaagtgttaattgatctgccaaaagcttcagtccatccgtttacctttgaaaccgttcatcccgacagcgacctgcacggacgccacttttcatccccgtattcgggaacgattgaagaccccgtgaccggcacagcatccggcgtgatgggggcttatatgaaacattatggcaatgccgagcaggataaatttatcattgaacaagggcaggaaattggaaaagacggaaaagtggagatcgaaatgaacgaagccggcggccatgtgaaagtgaacatgacaggaacagccgtttactcagaaacccgtattcttaaaatctaatacggatgatggtttacaaaaagatgcactttccgttatcattatgaaatgataatcattttcaattgcataggaaggtgagacggtatgcctcaaaccgaacaaatacatcagcattcagtactgcgggacatcatacgcagcagaagatcgattcgaaagtttaaacaagagccagtaccttcagcagtcattcttgacatgcttgaaacggcaaaatatgcgccaaatcacagagtgacagagccatggagatttatttacgtttccagtgagtcaggtaaagcgaacctcatcaatacatttgcagcgttttctaagaaatccaagccggatatgacagaggaaaagcttcaaaatttcaaaaacacacttgggcgcgttccgggatttctcctcgtcgtgtttcaggaagatgaaaacgaaagagcgcgggacgacgattttgcggcaacaagctcgttgattcaaaatcttcagcttcttgcttgggaaaaaggaatcggcatggtttggaaaagcggaaaaatcctttatgacaaagaagtccatcaggcctttggtttgcaggataatgagcgtttcgccgccatcatacaaacaggttatcctgacgaggcgccggaagtgaaaaaacgcacaccaatccgcgaccggttcactgaaatgtaaaaaaccccttgtctcaaacggagacaaggggtttttcattaacgagatttctttttcgctctgttgtcggctgctttcgcacgctcttgcgcttcgcggtcatctgcatcagcaagctcggttgaatattcttcgtaaacgccgtcagtttccctttttaatgcatcgggaacttgtggaagcttttgtttgtttttatcacggtttttgtggatatgatttctgcccatatcaaattccccctaaaaagtgatatcaaacaaagatagtatttggttttaaggagctatgtattcctactttcgcttagcagctttttccgcttttttaaattcgcctgaataaagaacttcctgcatttttttcaggttggcgccttgctggtgcttctccctctttttttccatataaaggacctccttcaaccatgttattcttaaggttgacgcttcctgctgtttttatacagtctttcggtccgctatcagctgtgagagtgcaaattcaagatccgaatatgtaaaacgaaatccagaggttatcgcttttttaggaagagcgcgctgtcctttcacaatcaaaagactcatttcacccaatgcttttgataaaaagaattccgggacggggagccagtgcgggcggtgcttcacccgtgcaatcgcttttccgaattgcttcatgtccacaggattgggtccggtgacattcattgggcctgagatgccggcgttttccaccgcatatcggatcatctgggccgcatcctcgacatgaatccatgacagccactgccttcccgttccaatcgttccgccggccagaaacttataggggagaaccataagcggtaaagcgcctttttctccaagcatcacgccaaatctcgcataaactgtccggatacccatcgcttcaatatgctgtccttccttttcccacaggtgtgcagtatgactgagaaaatcctcatctgacgttgcagaatcctctgtgaaagttttctcaaggcttgtgccgtaaatgcccacggcactggcttggatcaatgtcttcggcttctccttctgtttctgaataagccgctgcacttcacgcgtcgcattgatacggctggagagaatgtgctgctttgttttatttgtccagcggccaaaaatcgattttcccgcaaggtttatccagacatcaatatgaggaagttcctgctccggggcggctccttccgtcagccattggacatatgtcatatttttttgttcagtttcccttgcgtttcttgataaaatataaacatggtgtccctggcgggtaagaacgcctgtcagatgctggccgagaaaaccggttccgcccgtcattgcgatattcatgaacatctctcctcatcgttctaataaatatactttacctcattgtaataaaagaaaacgcgtttcaggcctgagaagggagattaagatgccgtttattacaaaaatatcaacgcaaaaaaagaatacggaacgcttcaatatttttctggatgataaatacgccttcagtgtggacgcggatgtgctcgtgaaatttgagctcaagaagggaaaagaactcgatgatcttgacatcattgagattcaatacggcgatgaagtgaagaaaggcttcaaccgtgcgcttgactttttatcctatcgaatgcggtcgacgaaagaggtcgaggaccacttaaagaaaaaagaaacctcgccccccgtcattgcggaagtcatccataggcttaacgattacaagtacttaaacgaccaggaatttgccgcagcctatgtcagcactcacaaaaaaacaaacggaaaaggccctgatgttttgttcagagagctaagagcgaagggaattgatgacgatacaattaaggaggcgctaagttccttttcctttgaagatcagacaagagaagcggtcaagcatgttgaaaagcttctcaaaaaagataaaaagctttcgacgaaagaattcaaacagcgcgcccagctgcagcttcagcgcaagggcttctcatttgatgttatcagcgcggcgatggatcagattgaatatgaaaatgatgaagacacggagaaagaagcgctgcgccttcacgcggaaaaagcgtttagaaaataccgctatgacggctcatatgaaagcgccatgaaggtcaaacaatttttattccgcaaaggattctcactcgatttaatcgagcaattactgcaggaagaggagtactgaaatggagaaacgatacagtcaaatgacacctcacgaactcaataccgaaatcgcattactttctgaaaaagcaagaaaagccgaacagcatggaatcataaacgaactggcagtgctcgaacggaaaattacgatggcaaaagcatatttgctgaacccggaagattactcaccgggagaaacatatcgtgtggaaaacactgaggacgagtttaccatcagttatttaaatggcgttttcgcgtggggatacaggacctcttccccccagcaagaggaagctctgccaatctcagtattgcaagaaaaagaataaagcgtaacaggaggctgatgatcagcctctttttgtttgcagcacatttacacgaattcttaaagaaaaaatcattgaattcacttgaaaaatcttttaagatgaaactcgttgttttttaaaatcaaaggaggcgatgacgttgagtatcaaaaacccatctgtaaaatttattatatttgttcttatgatttgtacattttcaatcggctatacagaatacgcggtgatgggtattttgacgtcgattgccaatgactttcatatacaggtttcatccgcagggcttcttgtcacggcttatgcggcaagcgtttgtttgacaggaccgctcgtcaccatcatttccgtcaagcttccgagaaagcctgtgcttcttgggcttatggcgatatttatcctttcaaacctgatgagcgcactggcgccgaattttgcggtattggccatttcaagaattttatctgcgtccattcacggcgctttcttcgcgattgccatggtattcgcaagtgaaatggttccgccggaaaagcgtgctgcagctgctgcttcaatgaacggcggactgacagtggctctaatgcttggtgttccattcggctcttatctcggagatgtcctgaattggagagcggtgttttccatcattacggcacttggtgtcatcggatttttaggccttatggctgccgtgccgaacagaaaaccaaaagtgatcccaatgcttatgaatgagtggggggtttttaaacacaaacaagtgctgttttccttcgcgattaccattttaggctattccggtgtctttatcgcctacacctttatcgaacccattttaaggcattcagccggattcagcacggttggcattacaggtgctctctttgcgtatggattgggaggcgttgccgggaatttctttgctggaaaggtaccgctgcctttgctgactcggacgatgatcggcgtaatgatcggtttaatcggtgttctggctgtatttccttacatcgccatttacccggctgcagccattgtggcaacgttcctattcggggcatgcgcattcggcacgccgcctcttctgcaaacaaaggtcatttcctcatctgagggcggcacaaccattgccgcagctgtcagcgtatcagcatttaaccttgccaatgcccttggtgcatggatcggcggaatgattttaaacggaacaggctcttattcctggctgtttgcaggaggtgcgcttatgactgcatgcggacttgtgctttctaccttcgcacacttatcagaaaagaagagcgtctacgaatatcaagtcaataaagggtaaaaacagctgcagtgtatgcagctgttcttctttaccgtttgcctgaggctctcattctttcttgaggatgctgattgatagatccgtcagcacgctttgaagcataatcgtcctttgctctcggttcaccctgaaatttgttttcgttttcgtaaggaaatcctttttctttatttcggaccatgtcatatccccctagattcgagatcaaaaagttgcgtctttccagatgaagacgtaaggttagtatatggagaacactacgtaataaagcgttatttttttcctgaagaaaggagactgcacacatgaatatgtacattgagaaactgactaatctgcttctggaaaagaacgagatgatcagctatatacaggcaaaaacgtgggtggaattgttatggagcgatttcgaagcaacctatgcaaaagccggacacgcctatcaaggtgaaaaaatgactgaaaaaatcgtcacacaatggattgaaaactatggcggccagctccacctttttcaaagctcccgtaacgacgtgaatgattacttaaatcaaagcagaggccttttgcattaaaaacctgccgttaacgaccggcaggttttttcattttcttaaaattaccttaacaggaagaaatcataaacaaaacatgtttcaccagcctgtcaatcagggaataccacttatatcttgtcaaaatgcgaggaggagctttatatgaaaaagaaacaagtaatgctcgctttaacagctgccgcaggactgggtttgacagcacttcattccgctcccgcagcaaaagctgcgccccttcacgacatatctgtcagcatgccatcatccgattcttacatcataaaaacaggaaagctgaatgtccggactgagccaaatcataaaggtgacattctcggcactgtatcatcagaacaaaaagtaaaagtctatggatttgtaaatgccgattgggctcaaattcatttcaaaggaaaaaaagcgtatatttcaacccactttttaatgaaaaccgcaagccaagcgaaaacaatgaaacagacagccttctatgcaccgacgcccgaaaatggaaaagctaaacagctctcatctggaacagaggtgacaatacttgggtggggattcagtgaaaacggcggatttgacttcacttgggcgttcgtggattatggcggagttaaaggctatattcacacaaaggatttacaaatgcgataaaaaggcaggccgaggcttgtctttttgcctatgcatgaaacatttctcctttctgcacgtaacaatgagaaaggagatgatgatatgacgggtttagtcggcggagggcttatgatcattgcgggcatactgatcaaactgtttcctcccaaatcgatcaacagtgtgtacggatacagaacgagacgctcaatgtcagatcaaagattatggaatgaagcgaaccgttacagtgcatcattaatgatcctgtcaggcttggtgattgcgggaatgggtttgctgctgggatcaaacttgtttattcttcagcttatcctgctgattgccgcctgtgtcataacatttatgctaacggagaaaaggctgaaaatcatgacgcacagtcaaggaggagatagaagtggacggagttaaatgccagtttgtcaatacgaacggaatcacgctccacgttgcagccgcaggaccggaagacggcccgttaattgtcctgctccatggatttcctgagttttggtacggctggaaaaatcaaatcaaaccgcttgttgatgcgggttaccgggtcattgctcctgatcagcggggctacaatctcagtgacaaaccggaaggaattgattcatatcggattgatacattaagagatgatatcatcgggcttattacgcaattcactgatgaaaaagcaattgtcatcggtcatgactggggaggggctgtcgcatggcatttggcttccacacgcccggaatatcttgaaaaactgatcgcgatcaatatcccgcacccgcacgtcatgaaaaccgtaacgccgctttatccgccgcaatggctgaaaagctcgtatatcgcatacttccagctccccgatataccggaggcatcactaagggaaaatgattatgaaacattagacaaagcgattggattatccgaccgtcccgcgctttttacatccgaggatgtcagcaggtacaaagaagcgtggaaacagccgggcgcgctgacagctatgctgaactggtacagagccctcagaaaaggaagcttggcagagaaaccctcttacgaaacagtaccttaccgaatgatctggggaatggaagaccgctttttgagcagaaagcttgctaaagagacggaaaggcattgcccgaatggacatctcatctttgttgatgaagcttcccattggattaaccacgaaaagccagccatcgtcaatcagctgattttggaatatcttaagaaccaataagctaaaatttctctccatccgtctgtcataatggcagactttttctgtgcgtttttttcatagtctgttttaaacatgacaaaataacattaaaaatcatgcatgtcaccataaaattgtaacaaaaaacaggtttaaacgactttaaaaaaaggaatagccttactgaagatttgtgtaaaactcccctaaggcaatacttaaaaagaataataaaaagaaggtgccttaatgaagcaaggattaatctcgattattatcccgtcttacaatgaagggtataatgtcaaactcattcatgaatctttaaaaaaggaatttaaaaacattcattatgactatgaaatattcttcataaacgacggaagtgttgatgacacgcttcagcagatcaaagacttggcagcgacgtgcagccgggtaaaatatatatctttttctcgaaactttggaaaagaagccgcaattttggcgggctttgagcatgttcagggcgaggcggttattgtaatggatgccgatctgcagcatccgacatatttgctgaaggaatttatcaaaggctacgaagaagggtatgaccaagtcattgcccaaaggaacagaaaaggggacagctttgtccgctcactcttatcatctatgtattacaagttcattaataaagcggtggaagtcgatttgcgtgacggtgtcggtgacttcagattgttaagccgccaagctgtgaatgcacttttgaagctgagcgaaggaaaccgcttctcaaaaggccttttttgctggattggctttgatcagaaaattgtattttatgaaaatgtcgaacgaaaaaacggcacctccaaatggtcgttcagcagtctgtttaactacggaatggacggcgtcgtttcatttaatcataagccgctgagattatgtttttatacaggcattttcatcctgctgctttccatcatttatatcattgccacattcgttaaaattctgactaacggtatttctgtgcctgggtatttcaccattatctcagcagtgttatttctcggcggagtacagctgttaagcctcggaattataggcgaatatatcggccgaatctattatgaaacaaaaaaacgcccgcattatttgatcaaagaagcgaatatcccgaacaaagacctgcctgaaacgaacgaattaaaaagcatgcggcgtctgacaaaaatgcactgaaaataccaagcgccattggcagtgctttttttgcgtgtctattatcttaaaagcaagactggagaatttatatgaaaagaaaacatatcatgatctatgcggccagtttgctggtgtccgttctggcacacgctttttttgtgaaagaatgggcggaaggcaggtatatgacaggtccgggtgacgggcttgcgcaaatgatcgtatttaaaaaattattatttgaccaatatacacacgggaattttttctacaattattcattcggacttggcggcggcacattcagtcagctcggctattatttttctgcgtcttttctttttcttgctgtgtccgccgctgtttggctgtttcaagccgtccagcttatcggagaagcggatacgcttttttgggctgagtcagctgtttttatcagtattttcaaattgagcttggtcatctttatgtccgcttctgtttttcattatcttcttaagcacagggcggcatcgttcacgggagccgtgttatacggcgtctcaattatttatttccgtcacgaagcgtattgggaatttttcaccgatacaatggtttggcttccgctgcttgtgcttggcgcagaaaaaattattagagagcggcgtccggcgtggtttatcgttgcgtgttcgctgacgttaatcaataacttttactttgcatacataaaccttatattcatcggaatctatgtgctgttcagatggctgatccgtttggaaccacatgaagagaaaagatggattcaaatcagattatttctcgtttcaggcttcatttcttttggcatcagtgcggcggcgtttgtgccggtagtatacggttttttaaacaacctgcgccctccatacagccagaaaatagagtggctcaatttcgatgataatatcttattttcgagccggatcatcattgtgccggccgcttttctgctgtttttgtttatgatttctttttacaaaaaccgtgtgtttcgtctctttgccgggttgagcctgctgtttattctgtttcatttcagtccgtatgcggcaagcgtctttaacggtttttccgccccgcaaaaccgatttgaatatattctggcctttaccattgcgggagcagctgcggctggtttgtcacagctgtctgaattgaaacggaaagaactgctcccggccgcagctgtcgtcctgcttctttacttgtatcatattcaaaggtataagctcgatatatggaagcctgcgaatgaaagtattctattgctcttactcatgacaatcgcagccttgtttgctgcagcttttgcgaaaaaacgggcaaaaatggctgtgtacggtataatcattctttcttcgctgtttgtcgccaactcctatcaaaaatacgcgctctcagaaggcggcgatttggatagtgtgacaaaagaatatcttacaagtgaggaatacagagggcgggaatcatctgagctcatcagacgtttacagaaggaaaacgatgatccgctcatgagaatcgactggatgaacggggtccgcaataatacgccaatcatttacgggtttaatggcttcagcgcctattccagcattttaaacaaagatctgctggccttctattggaatgatttaagcatcgatatgggcagggaaagcgtcagccgttacgcgtcattgggagacagggcgaatttatacagcctgctttacggcaaatattatatgaccgaaaaaactaacgaagccagcgttccgtacggcttcaaaaagcatttagaaacagagcattatgcagtttatgagaatcagtacatgcttccattcgtcaaaacagcggatgccatatacagcgaaagtgagctggaccgattgcccgctcttgcgaaagaacaggcgatgttgaaaggaatcatattaaaagatccatcaggaaaaacggagcagacaccaaaaccgtccaatttgaagtcggacatcaccgcaaaacaagcccagtatcaaaacgggctgctaaccgtaactggagaaaacggaggagagctgatcatcaccccgaaacagccatcatccgctccgggagactactatgtcagcttttatttgaaaagcaaagcaagagacaaaggatttacgttaaaggtaaatgattatgtcacaacaaggaaatcgaacaaatcgatatataaaaccggagtaaataatataacggtaagagtgcctaaatcaggccatatctcaatcaatcttccgaaaggaacctatgagctgagaaacatagcgctctatgaagaaaattaccaaacgctgaaaaacgctgtaatgcaaaataaaacagagaaagcagacaaactgaattggaacaaaaatcgactgaccttttcctatcatctgtcaaaagaccagtacatcatgcttccgatcccatatgaaaaaggctgggagctgaagatcaacggaaaaacacagaagatcgaaaaagcggattatgcttttataggcttcaaggcgcaaaagggagacaatcacattgagctgacttactatccgccatacttcaaaatatcggcagtcatatctctcgtcagtctgctgtttgctgttttctatataagacgtaaaaagcccggctctatatagagccgagctttaattttttctgaagtttttcttcgctgaatatccatcccgtataggacgaacgaatcgtgagatcatggccgatgtgaacaattgcgacaaacggataatggcctttgctccgataacgcaggtcgataaatctcacctcataatgatctttaaacgtatccacttcccaccggtaaaccggagaaaaggacagaaacgccgcgatgttatcatcctgctttgccgcatgcattacatcggtttcaggaacaggcacccgattaaatgtatccagaatcactacatgtccttccatgcttcttcctacatagaaagcatgtgctgtcgtcactgcgattcgccattgcctgaatttcatcgttggagaaataataatgctttcgatctcatcatgaatcatctcatgaagcttccgtttaattctaagctgcatgatcaggcgcaccaaataatagcctgccaatatgatatataagctgagaaacgtgatgccgggactcccgcctgcataccaaatcgcgatagctgccagatggctgataaaaataaacggatcaaacgtattaatcagcccgagcgctacccattttttcgaaaacggacgaatggcttgtgttccataggcgttgaatatatcaacaaagacatgcagaacgactgccagcagtgtccacagccacaggtgcagaaaatcagcctgaggataaaataaatacagaatcgccgggatgatgacagaccaaaacaaaacggcgggaattgaatgggtaaatcctctgtgattccttatataaacagcattgtttttaagctttaacacagtatcaatatccggagcctgagagcccgcaagcgttgcgatcataacagcgtgagccattgccggatctgatccgacaacaggatcaagcgtcgcaataccgcccagtgcgatgcccataacgacatgtgtgcccgtatccataggtgacctccttgcaggatgatcctgcacattcactttgtaagaaattcccctttttcatatacccaatttttaaactgattcaatcgttctcatatgtttccgctttttctttattactatttaatgtaacatattatcgtactgtgcccttagtgtacaacaaaaaacagtctaaagaaaagcggggcgcgaaagactggggagaaacacatatgaacgtacttgaagacaaattaaaacaaaaagacatacagcaatttcgcgatgatttaatctcatggtttgaacgagagcagcgcgttctgccgtggagagaggaccaagatccatataaggtgtgggtatctgaagtgatgctgcagcaaacgagagtagagacagtgattccttactttctccggtttgtggaacaattcccgacagtggaagcgctcgctgatgctgatgaagaaaaggtgctcaaagcatgggaagggctcggctattattcgcgagttagaaacctgcaaagcgcggtaaaagaagtgaaacaggaatacggcggcattgtccctccagacgagaaagattttggcgggttaaaaggcgtcggcccttatacaaagggagcggtgctcagcattgcctacaataaacccattcccgcagttgacggaaatgtgatgcgtgtcatgtccagaattctttctatttgggatgatattgccaaaccaaaaacaagaacgatctttgaagacgccatacgagcttttatttccaaagaaaaaccatctgaatttaatcagggcttgatggagcttggagccttgatctgtacgccaaaatcaccctcatgcctgctatgcccggttcagcagcattgctcagcatttgaagaaggcactgaacgggagcttccggtaaaaagcaaaaagaaaaagcccgggatcaaaaccatggccgcgatcgtactgactgatgaagacggacaagtgtatatccacaaacggccgtctaaaggtttgctcgccaacctgtgggaattccctaatcttgaaacacaaaaagggatcaaaactgagcgtgaacagctcattgctttcttagaaaacgaatatggcatacaagctgatatcagtgatctgcaaggtgtagtcgagcatgttttcacccacctggtatggaatatttcagtgtttttcggtaaagtaaaacaagtgtcggataccagcgagctgaaaaaagtaacgaaagaagagctcgaacaatttgcgttcccggtgtcacatcaaaaaatctggaagatggcagtagaagcagccgccatctcggctgctccgtaaaccattcttaatcgtaagagacgcgcgtgccgtggctgtagtccgcttcattgcgcttcattccgccgcgcgcttcaatttcttgcgttaattcccggtattttgattggccttcttcgttcaaaaaaggcataatttgctgaaaggcatgatgaaaataagcgagttcactgttcttccaatcttttttggaaaccatgttcaattcgctcatatcacgtccgacatacataacagaagaccccctttaaagttcttgccattattgtttgtggaaataaaagaactatacgctacaaggagatgaggaaaaatggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaatcgaaaagcttggcgttaaagttcttgtcgtaaaagcaaacgtaggacagcctgcaaaaatcaaagaaatgtttcagcaaattgatgaaacgttcggcagacttgatgtttttgtaaataatgccgcatcaggagtactaagacctgtcatggaattagaagaaacacactgggactggacgatgaacattaatgcgaaagcattgcttttctgcgctcaggaagctgccaagctaatggagaagaacggtggcggacatattgtcagcatcagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaagcacttcccgaatagagaagatctgcttgaggatgcgcgccaaaatacgccggcgggacgcatggtcgaaattaaagacatggttgatactgtggagtttctagtgtcttccaaggctgacatgatccgcggacagacaattatcgttgacggcggacgctcactgctcgtttaaaaatttttaaaaaagaggaatagctatacgatcacctgcacattctaatgaccgtggaggtgataacaatggctaactcaaataacttcagcaaaacaaacgctcaacaagttagaaaacaaaaccaacaatcagctgctggtcaaggtcaatttggcactgaatttgctagcgaaacaaacgctcagcaagtcagaaaacaaaaccagcaatcagctggccaacaaggtcaattcggcactgaattcgctagtgaaactgacgtacagcaggtaagacagcaaaaccaatctgctgaacaaaacaaacaacaaaacagctaatcactgaaacagaaaaaagcacttcatcttcgggtggaagtgcttttttctgtttgaaaaacgacaaaacttgtggaaggtctacagaatgagtcaaagggtttgctttatggagatcgaaatgattaaaggaggaaatgtttatactttcatcaggctgaaggaggaaccgatgacggaatttgaaaagctggtaagtgaacagatgaaaacgatggataagcttctcgatctccaatcagagctcgaccgctgcaaacaaattgaggcggaactccggcatttggaaagggatgcaaagctgcgtgggattcaggctgaaattgcggtaaaacggaaacaccttgccgatatacaggatatgtttcaaaagcagacagagcaggtcattcgttcatatcgcagctcagaaaagccgtcttcctttgtgtagtgcaggaatgtgccattccccggccggaatggctcttttattttcatttttcaatttgtaacgttataataggtaaaagacgttgtcggtaagcaaatttggacatactaactgtagggctttatagaaagtaggggagaaatatgggctatcccaaggaaggagaaaccattcaaattcacagctataagcacaacgggctgattcatagaatttggaatgagacaacaatcttaaaaagtacagaaatgtgtgtcatcggagccaatgaccggacgatggtaaccgaatcagacggccggacatggataaccagagagcccgcaatctgttattttcacgcaagacaatggtttaatgtcatcgggatgctgagggaagacggggttcattattattgcaacatcagttctccgtttgcctatgatggcgaagcaattaaatatattgattatgacttagatgttaaggtttttcctgacatgacctacaatattctcgatgaagacgaatatgatgatcatcggaaagccatgaattatccaaaagaaatcgacagtattttaagagactacttaaatacgctgctccattggattcaccagcgtcagggaccgtttgcacccgagtttgtcgatatgtggtatgaacggtatttgcgctacacaaaataatggttacgtaaaaacctgttgcggggtacaacaggtttttcacatgggctcacacacatcatgataaagagagagggggaatcaacgtgggggttatgaaacgctacatgcaattcgtcaaaccttataagaagcaaattttcgttacagtgttaatcgggatcgtaaaattctccattccgcttgctctcccattgcttctgaagtacgtagttgacgacattattcaaggaggcggcacggctagtgacaaaacaacgtcattgttcacgattatggcgatcatgttcgccttatttttaattttgcgcccgcctgttgaatattaccggcaatattttgcccagtggactgccagcaaggtgctttatgatataagagctaagctgtttgaccatatacaaaaactgagcctgcgtttttacgcgaatacaagaacaggggaagtcatttcccgagtgattaatgatgtagaacaaacaaaggatttcgtcatcacagggctgatgaatatatggctcgatatgctgacgattttgattgtaatctctatcatgctcacactggacattaaattaacgctgatctctatcgttttattcccattatacggaatatcagtgaagtatttttacggccgtttacgaaagctgacaagggagcgctcacaggctcttgctcaagtgcaggggcatttgcacgaacgcattcaaggcatgcctgtcatcagaagctttgcgatagaagatcatgaacaggctcaatttaatgagaaaaacggtcatttcttagataaagccatccgacacacgaattggaacgccaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtgtttgaatttattgacgagccctacgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaggatacctttttatttagtgaaacgattcgggaaaatatcgcgatcggcaagcctgatgccacacttgaagagataatcgaagccgccaaagctgcaaatgcccatgaatttatcatgagttttccagaaggatatgagacccgggtgggggaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacgggacaatcattgaaatcggaacccatgatgaactcatggactatgagagccaatacaagcacttatttaccattcaaaatttgaactaaaaccaatcttatatccttttaacgaaggatataagatttttttgtatataaaaaaacccggctgtttaaccgggttactcttctgtttctatttcgcagtctttcggatgatacgtttgaaaacttgtgataagtgtttctaaatgttcaagctgctcgcgatattccacggcgcttgccataatattgagcatgttgtaatcaataagctcctcatccgtattctgctgattttttaaaaatgactttgttaaaagctgcttataccggatgccttcttcaaccgcgtcatcatgcggcttgatttttccgacaaacctcatcaaaatccgttcgtgccagtaaagcaggtaatcaagttcttcagtcaatgtttcctgaaactcttccggcatatgatagatctcgttttccagacgatgcagcttcttcaatgtatcaagcgcccgatttgcagtaataatggcctgtctgaacaggacaagctttcttgatttcacataagtcgttttcttaaagtaacttctttcttctttatatagaagatatgtctgatcaagcttgatcattttttctttcagtttttcaatatcctctttcaaaatcgaatgctctgtcgactgccgcatggacaatctgatccacttcataatttcttcggtgttttcgacggtattatgaatcagttttgtttcgtacttaggaggcaaaaacacaaggttgacgataaaggaagaaagcacccctaagatgactgtgcttgttctgatcagcgcgaacattaaaaagtcgtcaccggcagattctaatatcgcaatgactgttacaagagcaattgaaattgtatgttcaattttaagtttcagcatgattgtaatgacaataactgctgttaacccgatcataatcgggctgggtccgaaaataaggccgaacactgtggcaatcacagctccgatgatatttgcttgaacctggtcaataataatgagaaaagagcggtaaatcgacggctggatcgcaaatatcgctgcaattccagcgaaaatcggcgcgggaagcccgatccacgaagccaaataaagagcaagtgtaatcgcaatcccggttttgaaaatgcgggcaccaagtttcattggtttgtgcgtgcattcctttctatagtaaattgtgtgacatagcaaatgggctaatccttaaaattcccggttagtttatttgctaaacaattaagtaatatacagggatcgatacaaatattcaagctatttttctagaaaaagaccaaaatcttacacgttgtttgattccataaaaaaacaggagcccaaagctcctgttcaaagtatctgattctagtttttaagatgtttaaaagcatcctcgaccgctgcaagcgtgtctttaatatcctgctctgtatgtgctgtggtaataaaccaagcttcatacttagaaggtgctaaattaattccgcgttccagcatcagcttgaaaaacgtagcgaatgtttctccgtcactccgttcagcctgctcgtaattttccactttctcatcagagaagtataccgtgagcgcaccttttaaccggttgaccgtaatggtgatgccgtgtgtttctgcgtgcttcaaaatgccttcctcaagcatagcgccaaggtgatcaagcttttcatacacgcctttttctttgagcacttccagacaagcgatgcctgataggatggaagcggggttccctgccattgttcctgcctgataagcaggccctagcggagctacctgctccatgatttcttgtttgccgccataggcgccaatcggaagtccgccgccgataattttcccgagtgctgttaaatctggtttcacctgtaagagatcctgcgcgccgccatacataaagcggaaagccgtaatgacttcatcgtaaataacgagagcgcctgcattatgtgtcaattcatttactttttctaagaagccctctttcggctcgacgataccgaagttgccgacaatcggttcaacgagaactgccgcgatttcactgccccatttatcaagagccgctttatagctatcgatatcattaaatggtactgtgatcacttcgtttgcaatgcttttcggtacaccggctgagtctggtgtgccgagagtagacgggccggagcctgcggcgacaagcacaaggtccgaatgcccgtgatagcagcccgcaaatttaatgatttttgtccggcctgtatatgcgcgagccacgcggatggtcgtcataacggcttctgtacccgaattgacgaatcttactttgtccatagcgggaatggcttctttgagcatctttgcaaatgtaacctcgtgtttcgttggtgttccatacaatacaccgttctctgccgcttttttaatcgcttctgtaatatgtgggtgggcatgtcctgtaataatcggaccgtacgccgctaaataatcgatgtatttgttgccgtccacatcccaaaaataagcgccgcttgctttctccattgcaacaggagaaccgccgccgactgctttatatgatctagacgggctgtttacaccgccgacaatgtgctgtaatgcctcattgtgaagttcaattgattttgtatgcaagaataaaaacctcctatatctccatgcgtcctttctattgtagcatgcttccgaacaagaacaatggcttcgggcttcagattcagctgagatggttgtaatccggacaagaattggatacgcttaataaaaaaacatccggaggtaacgtaatgactatagaaatcggacaaaaagcgcctgatcttgagttaaaaggcgatcatggggaaacagtaaaattatcggattataaaggaaagtacatcgtgctttatttttatccaaaggacatgacaccgggatgtacaactgaagcatgcgattttcgggacagtcacgaaagcttcgccgaactggatgccgtcattattggcgtcagcccggacagccaggaaaaacacggaaaatttaaagagaagcataacctgccatttctgcttcttgttgatgacgagcataagctggcggaagcgtttgatgtgtggaagctgaagaaaaacttcggaaaagagtatatgggaatcgaacgttccacttttttaattgataaagaaggccggctcattaaagaatggagaaaagtaaaagtaaaggaccatgtagccgaagcgcttcaaaccctcaaagatatgtcggaaaagtaaatctctatgagcctatgcttacttttaccctgatatcaattgacaaattatcgtagaaagagttacactaattataaacattacaatgtaagaattttttttagaagagaggtgcatgacggatggctgcacatgaactaaaagaagccttagaaacgttgaaggaaaccggagttcgcattactcctcaacgtcatgcgattctggaatatctcgttaactctatggctcatccaacagcggacgatatatataaagctctggaagggaaatttcctaacatgagcgtagcgacggtatataacaatttgcgtgtgttccgagaatcaggtttggtaaaagagctcacatacggtgatgcttccagcagattcgattttgtgacatctgatcactatcacgcgatttgcgaaaactgcggtaaaattgtggacttccactacccgggccttgatgaagtggagcagctcgctgcccacgtcacgggcttcaaggtcagccaccaccgtttagaaatttacggcgtctgccaagagtgttcgaaaaaagaaaatcattaaaaataagctgaccgcacgaaacggtcagcttattttatttcgacattttctttttattataagactcatcaaattcttttccttctaatcccttatctaaagtcagcggctctcggcaatgcatgcacatatcgactcttcctaaaacctttgtctctttttcacagcccggacaaatgacgcgaaccgctttggtcgaaagcattccgatccaaaagtaaactaccgtgctgagaccgatggataaaagcccaagtatcataaacaaactagaaagcaaaactgactctttgaaaaagatcccgatgtacataatgataaacccaacgaaaaccaaacttaacgcaaatgttctgattttattaattttgctggagtatttcgccatgtccatccccctctgatttaactatagcacaaacccgatgggattttcttcatgttttcggttgaactggaatttacatatggagagttactgtgaaattgtttataatagttcaatgtgtttagaaaaaaggaatttcgttttaaccatagaattgaatcaaatagagaataaaaaaatttgaacaattgcattggaggaatagtgatggaaaatcttctccgtccaatttaccaagaaagagcaagtcaccccaatacattggctgtcattatgattgagagaagaaacaaaacatcttccttaacagataactttgatgcagctttgctggtgattgtaaaggatgctgatgagccagtttttataaagcattatgaatttgatcatcaaacagcttctttgcatgtggtaacagattctcagattcaagaatggattttgcttggaacaaatagaagaatcatagattggattgtaaatggcagagtcttgtttgaccgtaatgaatacgtagttgaactgattgacaggctgaatacatttccgtttgccgaacgtaaactgaagatcggactcgaatacggcaaattaatcagaaggtatgttgaagggaaagctttttttgaagccaatcaatttttagatgcctacaacgccgttgttcatgcgctgcatcatttagcacgtattgaagtaatcgacagaggattccatcccgaaaccacggtgtggagccaagtgcgccagatggagccgcaagtgtacaagttatattccgagctgattgaaagtcacgagagcctggaaaaaagacttgaattattattcttagcaaatgattttctcatccattccaaagccgagatcggttcggcgcatcttttcgaagtaatgaaagaaaaagacatttggcaattcggtgagcttcttcaacatcatgacctaaagcactttacccaagatcttggcgttatgcttgattacttgacagaaaagggacttatcaacgtctgccagatagaaacgaaaggacaggctgtctatcaccgaggatattcttttaaaaaaggtgttgactctgattcttgaccgtgttatattattaaacgtcgctaatgcgcttctgagaaaacaagctcacagcggcgggaaaataaatcaaaaaaacatttgacaaaagaaagtcaaaatgttatattaataaagtcgcttcaacaagaagtgaaaatgatctttgaaaactaaacaagacaaaacgtacctgttaattcagtttttaaaaaatcgcacagcgatgtgcgtagtcagtcaaactagggcctgcatgacgcaggtcacacaggtgtcgccgcaggaagcggtggttcctgcggcgacacctgtgtgacctgcgtcgtgcaggccctagtttgactgactacgcacatcgctgtgcgatttataaaaatgaattaacaggtacgttttgtcttgtttagttttcaaagatcatttcgttacttctcaatgaagcagctttactaatataacattcagcttcttttttgtcaacaacttttttcaagttgttttgaagcatctagtttgtgtccgctgtgcatcagcgacgtttaataatataacacctctatttatttattgcaatagttttttaaaaaaatctataaaacaaataaactataatcctcgccatgatttctaaagcgtgtgtatcatataactttcttaaaagaacatatacatcagtcatgtgatcttgttgtttttttcgttttcttgtatagtagaaacgaactaaatactgatgaccacaaggggagcattaaagctgagagtgagcggtttcgttctgaccctttgaacctgttagttaacgctggcgtagggatgtggcaaagtcaaatgaattgcagatcgtaaagcagtgcgtggaacttttctcatccttccgcgtgctgcttttttgttgtccttttggttgtctgtcaatggaaggagatagatatgaatcaatctaagcaactggttcgccttattgaaattgccattatgacagcggcagccgttattttagacattgtctcaggaatgtttcttagcatgcctcaaggaggctcggtctccatcatgatgattccgatctttttaatttcgtttcgctggggtgtcaaagcaggtcttactacaggtttgttgacaggtctagtacaaatagcaatcggaaacttgtttgctcaacatcctgtacagctattgttagattacattgtcgctttcgcagcaatcggcataagcggctgtttcgcttcttcagtccgtaaagccgctgtatcaaaaacaaaagggaaattgattgtttcagtggtcagcgcagtttttatcggcagtttgctgcgctatgccgcgcatgtcatttcaggagctgtgtttttcggcagctttgctccaaaaggaacaccggtatggatttattctttaacttataatgcgacttacatggtaccttcattcattatttgtgcaattgtcctatgtttattatttatgacagcaccccgtctgcttaaaagtgacaaagcgtaaaagtaacaatcccccagcgaattccgctgggggattgttcgttatctgttaagaagtgtttttaaagctgaaagatccggccagccaagacctacttctttcaaccttactccggcaatttcaaagttgtcctccgctactctttcaggtgaataggcctgataaaatataatcgagggattctgctcaataacccaaacaaacatacttgaaaagccatgttgaagcaaatactccgctccttttgctaagagcgccctgcctgcaccttgccgctggcgctcttccagaagataaatagcgtataactcgccgtcatagccttcttgttcagagcgaataggtccaaatgaagcaaagccgaatactgaacccatttcgtcctgagcaacaaatactccctttaacgagcgacttttccatttgtcttcaaattccttatagttcaggctgtttaaataatcaatcgggatagtttcgtggtatgttgtcctccagctgtctacatgcacttttgcaatgtcctttatatcctctaacttcgcttcacgtacagttaccatacggttctgccctttccttactctgatttttggatcgttttggcttctttgatttcatttgttaattcattaatgctttgttttacgtttccttttcctgaaaagttctcaagcatttcttttacatcaattcctgaggatgcttttaaactttcttgcaaacttgacattaagttcgtcgcatagctggttactttgtttgctccgcttgattcaccgcttcctcctgtatcgacaacggtgattttatcaatatttgaaagaggtgcggctgcttgtttcgcgtattccggaagcattttgacaatcatatcgaaaatcgccgcctgcccgtactgttcaaaggcagccgcaattttctcttttgcttccgcttctgcaagacctttcaggcggataacctctgcttctgtctctcctttcgctttttccgcttctgcttttgctagcccgtcaattcttactttttccgcctcagcctttgccattgcttctatactgtacttcttggcatcggcttccgcgagctgtttggctttctcagctgctgcggactgctcaacagaataacggtctgcatcggcttttttctttacctctgagtcgtattgacgttcacggcgaagaatttctttttcttctagttctatttgtttttggcgttcgataattttaacctgcatttcctgctctgtgacttgctggcgcgctctggcagtctctaaatcatatgcttggtcggcattcgcttttgccgtatcttgttctctgcgaaattcagccattttgagctgattgagtttttcagcttcagcgatttccgtcgcccgttcaagttctgatttttttgcgtctttatcggcttctgcccgcttaattcgggtttctttatcagcctctgctgttgcgatatcagcatcgcgttttacttgggcaattctcggtttccctaatgattcaagataaccgtttttatcacgaacatctttaatggtaaacgagacgattacaagccccattttcgcgagatcctgtgaagcgacacgctgcacctcttgagagaatttttctctgtttttatagatttcttctactgtcattgagccgagaatggaacgaaggtggccttctaaaacctcccgcgcttcctgctcacggtcgtcttttgatttccctaaaaattgttcggctgctgtagcgatttctcctatagaaccgccgattttaataatcgcagttccatcggccattactggcactccttgttctgtatagacttcaggtgtcgaaacatcgagtttgcttgataataggcttagcggctctgcctgctggaagacgggaaggacaaaggttcctccgccgcggacgattttaatacggttgccgccttcatcgacatgaacatttttattgcccagatagctccccgttacaattaacgcttcatcaggccctgctgtacgatacttcgtaataaacacagctattagtgcaattaataaaaagaatacaactccgatgatcattataatcggcattgtcatatcaaattcctccttgtatattaaatgggttcatgcggagtaaccgaaagaactccgttgttaatatctacgactaacaccgttgtcccgtaactgatctgctgattatcaaaactgaccgctgactttgaaatggtcccgcctatcccttctatgaccacttcaccaaacccgtcaaccggcacagctgtaatcactttaccgagtcttcctctgagatcatcttctctatatgccaatgattcttctgcagatgataatggtaccagtacaaagatgtgaagcaataccaccagcatgatcgaaaggatgcaagataaaagcgcaatcagcaagcttgacagaggcaatacaagttcacctatatatccgcccgctgaaaaacatgtgaaaaatgagagcactaatgtcggattaagaaacggaatgccttctgacagtcctgcaaatacatctccgaaaaacaggaataatagcgtaaggctgcccgcaataataagcgtataaagataaattgtttgtataggtactccaaataactccaatttcctcatcctttcttcatcaatgcattgatgaacggccgccgttaccatttatacgagacaccacgggaaaggtttcaaaattttaagacaaataacccatttgaagtgctttataaatgataattgcttatatatatggtaatgtcattttaggaggagatatgatgagtatctttaatgaagccagattagaaacgtggaacgaattgaaaggactttctgacgaaaagctgaaccaaaagccttctgctgaagaatggagcatacgggaagttcttgaccatttgaaaaaaatcgatatgaccgcacaaaaaatgttgaaggaacgtgtaaaggacgctccgattaaagaaattgaagaaaaaccgcttgaggtagcacaggacagaaataataaacggaaagccccgagtcatcttgagcctgcgcatgattttatttcaggcagccaaatgaaacgtgagcttgatgtggtaagagagcagctgactgctgcgattgcctctctgaaagaagaagattttgaaagagtgcttccgcatcctgtgtttcaagagctgactgtcagacagtggatcgattttatcggccatcatgaaaaacggcacctcagccaaatgaaagaaattaaagaaaagatagaaagggcctgatttcatcagaccctttctgcttttcgtttgacttttcgctgataggaatgaacttctatttcatcacctgtgtaaacagcaccaggtctttccacaatacagacaatccctctaatgcccagtgcgtggcggacgaaagccggcgccagcttcggttggtccggataataagactgaatgacttctcccggctggatacacggatcattttcgccctcacacagcagagccgctccgctcggaaaaataatccggcttccttcttttaatgaagtaagatctggcataccgctgactgccacattcgccccgagccattccggcaaaatcctcggcactcccatttttaaagcgatttcgttgcattcctctattgaaacaattgaaatttgtctgcggttgaaaatttcagtccctcttgaaaacattggttctctggctcccgcttttttggtcaggccaaaatgcaagtcgccagggatgccgccataatcaaaatcaagcttgtccatttgctttgttacgaagctttctgtatctgcgatatataagccttccgcttttgcagtcatacgcttccacatcagctggcaccttctttcttatctaaaatttccacctatgcttcattatcccaaaaaatcccgctctgtaaaggagcgggattttgattataccgttttaggcgtaaggttaaagcagcgcttgtagatccagttgtatgctttttcatttaaatctctagggtttccgaaggtttgcggatctttcattgcttctttagacaagcgttcgatcatatcaggtgatactccctgctcttctaaagtcggcacttctaaatcttcgaccagatcatacatccaattgacagatgctttcgcagcttcttctgttgtcatcttgcttgtatcaataccgaacgctttcgcaatacgcgcaaacttctcaggatagcccttccagttgtattccatgacagggcccatcatcgccgctacacattggccgtgagcgactgggataataccgccaagcgtttggctcatcgcatgagcagcgcccgctgattcacttccgtaagaaagaccggcaagcatcgcagcctgcgccattccgtaccttgcttccagatcctctccatcagcaaatgccctcttgatgtaatgagcggcatactcaatcgccattaaggcaaccgcatccgtgattggctgtgcaaatttcattgtatagcactcaatggcatgggcgagcgcatcaattcccgtcatagctgttacatgcggaggcattgaaacatgaagctcaggatcaatgattgtcaagtgcgctgcaatcagcggaccgcccgtgttgaatttgaattctctttcttcatctgtgataaccgcccattgggttacttctgatccggttccagctgtagtgggaattgtcgtcagcggaggaatgcggttttccagcggttttttcccatctgccgcttcataatcaagcacgcttccttcgtgagtcgcttctactccgattgcttttgctgtatccatggagcttccgcctccgactgccaccaaaccattacagttctcttttttgtaaagctcagatccttcattcaccagacggacaggcgggtttggctcaactttattaaagagtaccacttcaatgcctgcttctttaagtgattcgattacgggatcagcaacaccggctttataaatcccagggtctgtgacaaggagcgcttttgaaacgcccagtgcagctacttcctcacccgtatgcttgatggctccgattccatgcttaatcacagtcggaatttcaaatgtgtggaatttctgcatgctttctaccttcatatttaatgtcatcatcaatctccccctcttatgaattaaaccagttaaccgctgccggttttgtattgcggtatacatgtttgacttctgtgtattcttcaaggcctatttttccaagctcgcgtccgaacccggattgcttatatccgccccatggcgcttgtgcaaagtacggatgaaaatcgttgatccaaacggttcccattctcaagcgggctgctacccgttcgcacttttcaatgtcttttgaccataccgctccagccaagccatagatggtatcattcgcaagctcgattacctcttcttcagagctgaaggtttcgactgtcaatacaggaccgaaaacctcttcctgaacgattctcatgtcagaattacagtttgagaaaatagtaggttcatagaaaaagccgttttgaagctcaggatcttccgggcgtttgcctcctgtctccagcttcgcgccttcctctattccgatctctacatatttttctacctttgccctgtgctccgccgaaataagcggaccgctttctgtctcagcatgaaaaccgtttccgagttttatgcgttttgcccgtttgaccagctccgccaaaaattgatcatgaatggcatcctcaacaagcaagcgggaacctgcagagcatacttggccggcgtggaaaaatacagcgtttaaggcctgatcaaccgcaacttctaaatccgcgtccttgaaaacaatatttgggtttttcccgccaagttcaagggcgatttttttgacgtttccgcttgccgcccgcatgatttttttgcctgtttcaattccgcccgtaaatgaaatcaaatcgacgtctttgtttacggcaagctcgtcgcccactgtggctcccggtccaagaacaagatttgcgacaccttttggaacaccggcttcttccatcagcttaaagactttgattgtcgtcagcggcgtaatctcactcggcttcatgacgattgtgtttcctgcggccagtgcaggggcgattttccagctcgcttgaaggagcggataattccatggagtgatctggccgcaaaccccgattggctccctaataattttgctttctgaatcaggaatcggagatgaaatgatctctccgccatctttgtctgccaagccggcgtaatattgaaaaacattggcgatatcgtccatatcggccttgctttcttcgagtgtttttcctgtatcaagagattcaagctcagccagctcctcaagatcgcgtctgattaattccgcaattttcagaacaatttttccgcgttcaagcccggatagcgatgaccattctcctttgtcaaatgctctacgtgcggctgcgattgctttgatggcgtcctctcgccctccctcgcttacagttgcaatttcttcttgattaaatgggttgataatactgcggatctgttctttttcggcactgatccattctccgtcaatgaataatgtttgactcatataagcctccttgacgtaaataaagtttgttaaataaaaatttaatgtttttaacaaccttaatctaacatatggtttttaaactgtcaaagtcccattttgatttttctttttgacttttcctcatgtttcgttaagataaagaacataaagaaataacttaacgaatttaattttctaaaggaaaagagggtcagtatggatgaaaatccagaatttgcagctatagaacaggctcgggatcttgttattgactccattgctgaaacgatggatctttacggaattacccgcagtgtcgggattttatatgggacgatgtatatgagggatgagatgacgcttgacgaaatgcgtgaggagttgcaaatgagcaaaccaagcatgagcactggcgtcaaaaagcttcaagacttaaatgtagtgaaaaaaacatttcaccggggcatccgcaagcatacatttgtggctgagaaggatttctttaaatttttcacaaatttctttccacctaaatgggagcgggaggttcaagtgaatgtaacagcgatcgaggaagctcaagctgatttacaaaaggttttatgcaaggaagatctcgatgaggatatcaaaaatgaagcactgcagttatatgatcagctggaaagctctaaagcttactatgactggctgaaacggcttgctgaatcggtgcagaccggagaaatttttaaatttataccggtcgaaacaaagtaaagcagaaaacgcctgggaaactaggcgtttttttgatgtaactactacaaatttgaaaaatacgggaaaaacaccccatttacttccaaaatatttgatggtaattttatgtaggtaaaatttgtatttggcctttcagaggaggtgaaaagcgggcaggcctgtttaatttatcattttttagggggaattttgttatgaaacgcaaattattatcttctttggcaattagtgcattaagtctcgggttactcgtttctgcacctacagcttctttcgcggctgaatctacatcaactaaagctcatactgaatccactatgagaacacagtctacagcttcattgttcgcaacaatcactggcgccagcaaaacggaatggtctttctcagatatcgaattgacttaccgtccaaacacgcttctcagccttggcgttatggagtttacattgccaagcggatttactgcaaacacgaaagacacattgaacggaaatgccttgcgtacaacacagatcctcaataacgggaaaacagtaagagttcctttggcacttgatttgttaggagctggcgaattcaaattaaaactgaataacaaaacacttcctgccgctggtacatatactttccgtgcggagaataaatcattaagcatcggaaataaattttacgcagaagccagcattgacgtggctaagcgcagcactcctccgactcagccttgcggttgcaactaatgtaaaagaccggttaacgccggtcttttttgcgttttaccctcccctttttctctaatccccgttatcttttttctggtttaaaatttaaattgacaaacactagaaacaggagtaaattcttgagtgttcaatttcatacagtctcttttaccgcttaatcaaacacgaacgggggaaccaacgattggctgttttattaacagccttggggtgaatcttactaagtaagagggggtactctgaatccctaatccgacagctaacctcgtaggcgtatacagagaggaggtctattatcggccattctttgcaatggtcttttttgtttcaaaaacgttaattcactaagggagatatgaacattgggaagaattaaaaataagcaatttgccgtgatcgggctgggccggtttggcggcagcatttgtaaagaacttcatagaatggggcatgaggtccttgcggttgatatcaacgaagaaaaggtcaatgcatatgcttcttacgccactcatgcggtaattgccaacgccaccgaagaaaacgaattgctttcattaggaatacgcaattttgaatatgtgattgttgccatcggagcaaatattcaagcgagtacgctgaccaccctattattaaaggagcttgatattccaaatatttgggtgaaggctcaaaactattatcatcacaaggtgcttgaaaaaataggcgctgaccgcattattcatcctgaaaaagatatgggggttaaaatcgcacaaagcctttcagacgaaaatgttttgaattacattgatctatctgatgaatacagtattgtcgagctgctggctacgcgcaagcttgattcaaaatcgattattgacctgaatgtaagagcaaagtacggctgcacgatcctggccattaaacatcatggagatatctgtctttcccccgcgcctgaagacatcattcgcgagcaagattgcctggtgatcatgggccacaaaaaggatattaaacgttttgaaaacgaagggatgtagacaaaggtgacacttcaaaaggataaagtgatcaaatgggttcggtttacaccgcctcaagtgcttgccattggttttttccttaccattatcatcggggctgtcctattaatgcttccgatttccactacgaagccattgtcatggatagatgccctttttactgcggcttccgctacaactgttacagggcttgctgttgtcgataccggcactcaatttacggtattcgggcaaacagtaattatggggctgattcagattggcgggcttggatttatgacatttgcggtcttgatcgtcatgatattaggaaaaaaaatcggcttaaaagaacgaatgctcgtccaggaagccttaaaccagccgacaatcggcggtgtcattggccttgtcaaagtcctgtttctgttttcgatcagtattgaattgatagcagcactcattttatccatccggcttgtacctcaatacggctggtcatccggcttgtttgcaagtttgtttcacgcaatatctgcttttaacaatgccgggttttcgttgtggcctgataatttgatgagctacgttggcgatcctacagtgaacctcgtgattactttcttatttattacaggagggatcggatttacggttctgtttgatgtgatgaaaaatcggcgttttaaaactttttctttacatacaaagctcatgcttacaggaacgctgatgttgaatgcgatcgctatgcttacggtctttattttagaatacagcaaccccggcacgctcggccacctgcatatagtggataaactgtgggcctcctattttcaggcagtgacgccgagaaccgcagggttcaattctctagattttggaagcatgagagaaggaacaattgtatttactttattattgatgtttatcggagcaggaagcgcatcaacggcgagcggcattaagctgactacgttcatcgtgattttaacatctgttattgcttacttgagaggtaaaaaagaaacggttattttccgccgttccatcaaatatccgattatcattaaagctttagctgtgagcgtcaccagtttgttcatcgtgtttttagggattttcgccctgacgatcacagaacaagcgccatttcttcaaattgtgtttgaaaccttttccgcattcggaactgtcggccttacgatggggcttactcctgaactgacaacagctggcaagtgtatcatcattgtcatcatgtttatcggaagaattggtcctttaacgttcgtgttttcattcgcaaaaacagagcaatcaaatatccgttatcctgatggcgaagtgtttacagggtgatatcaaaaaaatccggcgtgcagtcgccggattttttatgattcgatatgagattgattttgtcttttttcctgttccgcgatgatttcgttatcctccgcgttatcacgggtcactttttgcgtaagaatcgcaccaactgctacaagtatcataacagcgatgtaataacctttttcattgagttccagattatcagcattatagagtccgatactaaacaaaaatactcccgcaaaaaaagtaaaataagctagtactgtaaaggcaaccgtgtttctgcgtctatatttctgcacctttgttccctcccgaaagcatagttaaaaagtgataacttccgtggaatattatacctcaaattccccggaatggaacaaagaattaaaaataccagtaaaaagggcttaggttgcctcctttatttcaacagctgaatcatcaatccagccgataagtttatcattgatttggaattggtaccatacagactggcctttctgttttttagacacaacctttatgtctttgccgacgtaagattgggcagaggtaagccttatggaccgatcatcagtagaaggcttggaccatacgtcttgaacggcactgtctttaatagaggcgtttaaatccacagatttgagggatggatttacctcatcgtactcatctaaatcgtatttttccacaatagcgctgattttgtcagcgtagtcagggtctgtagcatatcctgatgtttgcagggcggttgccgcttccttataattccctgcctcaagcaccggtttatacttctttttattccacgatgtgccacggacgaacaattgggcgtgatcatccatagattcaaaaaacgtgctgtattttcgaaacttcgcgcgaatggtttttcttttccctttttcaacttcgtccgtttccatcgtgacatgatggcctttataattcccttttacgccaaaaaggttgttggccttagcagccagttcactgttcccccagtccgattcgagaatggcctgagcaattgtgatgctggggagaacatggtatttttcatacaaaatttgggcatgtccggacagactgtctataaatacttgctgttcatcgatttcttcagtttctttggatatttcaatcggttttgataaagttgtcgctaaaacaaacagagctagcggaatcgatacaaggaaaaatagtgaaatcaagagtttacgttttttaagttttttacgggccatgaaaaccttccttcgaattaaaagattacgaatgtaaaagaatctaccttttagaattttacttgcacttctaatatttttcaattctttagggataaagttgggaaaagattgcaaaataaaaaccttttcgctcaatgaaaaggtttttaccatgtttctatttttgtaaatttctgagtgcattccgatattccgtatcatttattactttatatgatttgacagttgccttcgacaaaccttgtgctgagacggccggtttttccggagctgttttcgctttatcatgtggtttatgtgccagcttgtgccccattccagtggcattcatacaaaatgacaggcagacgagcagcacgctaaggataaaagaaatgaagaagagatcatgataagcagtcatcatagaatcctgtaccgaaccgctttgtctggcagcatcttttttcgtgaaaaagccgatgagaatgggaactcccatatagacaaacaatcttaaaaactgaacagctgtcattctcttgaccaaatcaggcagcgggcctcccatggcagctcccatcagccctgcggcgactgtcaggcctgttcccgctgcaagcatgataaacagtgccgcgaacatataaagagatgatcgatcctgtatatgcagccattgaaaattcacaaaaacgagaatgagtccgccgataataccgagcatccctggtccgactttatcgtataacagagcgctcaaaatggccgcgatcgccactccgattaaaagagtcaagcttaaaagaatgagatgctcctgagaaatatcatacatttgacggagcaagccttgaaaagcagaaaggctgacagctaccgttatcgtccctgcagctatgatcaataagccgagcaccggttttggcagcagcatcagtttaatagatatgaaggggtttttcactttatattccacaatcaatagaccaatgagcaaacataacgtcaccccgaaaccaatccatacataacccgatgacagcccccatttttgcagaaaaatgaatgaaaccgctgaggctgcggcaaggaagacagataaaagaattcccgcacgatcaagcggctgttcttgatccgccgctccgtgatgctcatcatgaagaaagaaatagctcaccgcgacaccgatcagggacaaggtgccaaagatgaaaaacagccatctccaatgcccgcagcttgttgcaatggttcccaggattgtaccgatgataacagaaccatagaatcccccgatcagcacaagcagtgcatagttcctgcgttcaatcgggaatgacagtacaagcattggaatcataatcatcagcatgacgcctgttgccgccccttgtaaaaagcgccctgccgccatcaatgcaatatcgcctgaacatgcgatgagcagtgagcctagtataaagacaggtaatgaagccagatagacgggacgagcaccgaattttttcctcagcagcggtcctgccggaactaacaaggcaaaggccatattgccgatcaatatcggatttactgatgtaaagacacttgttccaaccgttttctgaacaaggccttgaactgacgacaatgccgtgttagacatcaatcccggcccgaccgctaagacggcgagcaaagaaatcacccaatagtgttttgtcttcatgttgtcatcccttcctatatgaatacatgcgaaacacatcattttttgaaaacaaaagaagctaatagattttgcataccattagctttcattctaatattctccctttcaggggaaatgatattattttattataattatgtgaatgaatgagcatataatcaaatattatttcaaatcgattgtgttttgtcaatggagtaaatttcaagcacaacatagaaagcttgaaagcttttccccgatattgtgtctagaactgcacttatgaatccctgctcgttccctcaagcgaattaaagcaggccgttttaatcctttcaatccactattccaactaataaactcaaataagttggtgataagacaacattttacccccacatttttttgtgttcactgggcgtttgccgcctctaaattgtatatgggtaaataccatgaattaacctatgaaataccaatgtaagggaggcaaaaacgaatggaactgtatgagtgtatccaagacatttttggcggcttgaaaaatccatcggttaaagatttagcaacgtctttaaaacaaattccaaacgcagcaaaattgagtcaaccgtatattaaggaaccagaccagtacgcttacggccgaaatgccatctatcgaaataatgaattggaaattatcgtgattaacattccgccaaacaaggagacaacagtacacgatcatggtcaatccattggttgtgcaatggtgttagaaggaaagcttcttaattctatttatcgttcaaccggcgaacacgcagaactctccaattcatactttgtccacgaaggagaatgccttatttcaaccaaaggtttaattcacaaaatgtccaatccaacatctgaacgaatggtgtctcttcatgtctactcccctcctttggaagacatgacggtctttgaggaacaaaaggaggtattggaaaattcatgattgacagataaactgctcactttgacttcactcaactggaggattcagagaatgaaaccttttcctcaaaacaaaaaaacccttatcgaataagggtttaaaggtatggagccaagggggctcgaacccctgacctctacgctgccagcgtagcgctctcccagctgagctatggccccgtatgtaacgtcatgtttattatagatgatttttttttgaaaaacaagcagtttcctcttgaattgacagaaaaaataaggctcggaaaagagccttatttttcgacttacatcatgatcaaaagtaaaatcacaccgagaataattcgatagattgcaaatgggacaagtttgattttgttaatcagccttaagaagaaacggacgacaaacagtgcgacaacaaaggcacagataaagccgacgatgaaaaatggcatcagatccgagcttaagctgtcccaatgcttcacgaggcttagaaagctggctcccatcatgatcggcatcgccataataaacgtaaagtcggctgcagctcggtggtttaatccgagaataacaccgccggaaatggttgaacccgaacgcgagaaacccggccaaagggcaagacattggaataagccgacggctatcgcctgtttataggaaatgcggtcgagtgtgtctgtcgctgttttccgtttattgacccagtcagcaaaaagcatgaggattgccccggcaattaaaccgatggccacagttttaacggaaaataaatattcatcaatgtaatcttcaaacaaaaagccgagaacagctgcaggcacgagtccgacggcaatttgggcaatgcttaatttatgtccctgctcctggtcgcttgtaatattttttttcaagcccagtaaatttaaaattcggtctttaaacacgatagctactgctaaaatggagcctagctgaataaccaccttgaatgagttagcagcttcttctgacatcagattacttgatttaagccagatgtcgtctactataatcatatgtcctgtcgaagaaaccggcgcgtactctgttaatccttctacgattcctaaaatggcggctacaaacaattcccatagagtcatgattttgattctccccattagacatttatttttttacataacgggagcttcccataaatggaaagcccgtcttatataactataaacgaaaatcacactttatgccccggcgtattttcatttttttcttcatcgtataaatgtgaccgcattttaaaccagtcaaataaatgtgtcgtaatgactttggcaaccgcatagccgggaatggcaagaatgattccgacaacgccaaacagcttgccggctgttaacagcagaaaaataatcgtaatcggatggatgtgaaggttttttcccataatttgcggagagatcagcttcccttcaatcagctgaacaatcgtccaaacgatcaccagcttaagcagcatgagcggcgatgtcactatggcaatgataatcgcaggcgtaatggcaatcgttggccctaaatatggaacgatgcttgtgcaagccgcaatgactgcaagcaatgaagcataatccagcccgataatcaaataaccgataaacagcaaaaacccgatacagaagctgacaatgatctggcctctgatataagagcttaaccgatgattcatttcgcttaagactgtgtatgtctgttctttcaattgcgtcggaacaaacttcagtatgtagaccggcaatttttttccgtcctttaacaaatagaaaaggataaacggaaccgtaacgattgaaatgataatctcagtcagggcgccgataaaattcccaacgccggtaaaggtgctgttcacgatcgtcgctgcctgatctgaaacctttgttgcgagatcagatatattgatgttcgtcgtttgctgggcctgattgacgaagttgctgccgatcagctgtttcgtctgattttcaacgatatccacatatcttgggatgttgtcgattaaactcataatttgttcttttaagaagggaatgatcgacacgattgtgatcgtgatcagcccgataaccaataggtatagcagcaatatagaatagattcttcttattcttcttctctcaaggaaatcgacgaccgggtttaacagataaaaaacaatgcctgtcaaaataatcggaagtgatatcgttttgagcaaaacaataatcggggtgaaaataaatgatgtttttgtaaatactagaatatttaaaccaatcagcagcagcacaagcaaaaataaaacaaacttattatccaagaagaatcgcttgaatctgccgctccatgtttgcaacgtctccactatcgttcctccgtcatacatagtttaattaaattgtacactatcgtccctataatgaaaaataaaaaccgttaattgctggaaaagctttcacggttttaacattctatttatatctatcatgtgattttgttctttttaagctataatttagctatatcatacaaaaggagcgatacgagtgatacgttttgcaataataggaaccaactggattacagaccgctttcttgagtcagcagcggatatcgaagattttaagctgactgctgtttattcaagatctgctgaacgcgctggcgagtttgctgctaaacacaacgctacgcatgccttctcagaccttcaggaaatggcggcgagcgattgctttgatgccgtatacatagcgagcccgaacgctcttcacaaggaacaagccgttctctttatgaaccatggcaagcatgtgctttgtgagaagccgtttgcttcgaatacaaaagaaacagaagagatgatctcagcggctaaggcaaacggcgttgttctcatggaagcaatgaagaccactttcctgccgaatttcaaagagctgaaaaaacacctgcataaaatcggcactgtccgcagatttaccgcaagctactgccagtattcctcacgatatgacgcgttcagaagcggaactgttttgaatgcgtttcagcctgagctttccaatgggtcattaatggatattggcgtctattgtatttatccggctgttgtgttgtttggcgcgccgaaggatgtaaaagcaaacggatatgctttatcctccggagtggacggagaaggaactgtcattctgtcttacgacgggttcgaagctgttctgatgcattccaaaatctctacttcctatgccccggctgaaatccagggtgaagacgggacgattgtaatcgatacgattcaccggcctgaacgtgttgaaatccgctaccgggacggccgccttgaaaacatcgcgatccctgatcctaaaccagcgatgttctatgaagcagaagaatttgtcacgctcataaaagaaaataagctggaatctgaagaaaatacatttgaacggtctttgaccaccgcaaaaattatggaagaagcaagaaatcaaatggggattgtataccctgctgatcaagcttaaaaaaatccgcccgcgtgcaaatgccgcggcggattttttattagacaatcggagaagatgccttcctttttaaaagcacctgttgctcatattctttgatgtcatgaagccatgcctcttttaccggaacgcccatttgctcacagtaggaatcccagatggctccgaaaggatatgttttgaattcctccatcagggccagcctttctgtatagcggccctcttcctgcaattgttttaaatatccgttcgggagaagcaaggcatacaataaagctttgatcatatttctcgttccgatggtccaggcggctacacggttaatgctggcatcgaaaaaatccagaccgatggcgaccttctcaagagcatgatttcgtacaatttcaagagcgatttctctcaattcatcatccaaaaccactacatggtcgctatcccaacgaacaggccgcgatacgtgcaaggcaagcttgtctgtgtaaagcagcatggacgagattttgttcgataccgtctcagtcggatggaaatggcctgtatcaagtaaacaaagcttatgattcgtcaaagcataagctaaataaaattcatgagatccgacaacatatgattcggagccaagcccgaacagcttgctctcgattgaatcaagattatgttgttcactgatctcctctgagaagatccgatccagtgattcttttagtcttttacgcggtgtcagcctatcactcgggatatccttatagccgtcgggaatccaaatattcgtcaagcaaggtgttcctaattctttcccgaagtattccccgatacggcggcaagcgatgcaatgcctgatccaaaattctctgatgtccggatcagggtgtgaaagggtgagtccgtcagccgctttctcatgcgaaaacaaggttggattaaaatctaaaccgagaccaaggttttttgcccatttcacccagttttcaaaatgctgcggcttcaattcgtcacgttctaccgcttccctgtttgtttctgcgtatatcgcatgcaggtttacgcggtgctttccaggaatgagagaaagagccttctccaaatctcttcttaattcttcaggagtttgcgcttttccgggataattgccagtcacgtcaattccgcctgaaagctcgcccttatttacttcaaagccttcaatgtcgtcaccctgccagcagtggatcgaaatgggcacttgctctaattgccgaagcgcctcttcaacatcaattccccatttttcatatgcctgttttgcactgtcataattggcttttatggtcatacggctctctccctttatcagtttttcaatccaaataaaaaacttcctttagatctatcgcaacaggactgaaatccgaatttgttttcattaatggcgccatcgatttccaccatctttggcaaacttccgtgtccgccatctttctccatttctcttcatcctctatttctaaatatgcaaaaagccggcctgtttcctcatctagaaaaatggaataatggtgggctccatgagctttgagtgcttctgccatctcaggccaaatgtcatcatgccgctggttgtattcttcgtacttgtcttgatggacaaacatgatactggcttttcttttcaaaccttttcacctcttcatcatttagatagcgctttcaaaacggtttgctgaaaggactgaatgatggtgcttctgtcaatgtctttaggtgtaaacactttgatcggaaaggaatttctgacgacttgccgggcttcttttatgtctttgacttctttggcagcaatcatttgcatcaaaagatttccggtggcagttgcctctatcggccctgcatataccgcttttccactcatgtctgccgttaattgatttaagaaatcattccgggctccgccgccgatgatatgaaattgctcgatcggtttttctgtgattgtttcgagctctttgatggctatcgcatagatgatggctaaattgctgtagatgcagcaggcaagttcgcctgcagtgcggggaatcttttggcgggtttgtctgcaataatgttgtatttcctttatcatgttttctggattcaggaatcgtttatcatttaagtttataaattgctggaatggttctgtttttttggcttcttctgcaagctgctggaaagagtaatctgcttgtaactgctgtctgacttcttgtatcgcccacatgccgataatgtttttgagaaagcgaatggtgttgtttgcgccgcgttcatttgtatagttgttttctaaagccagatcagttattatcggtgttttgttttcaaccccgattaacgaccatgttccgctgctgatatacgcccagccatcatttacgcctggcgccgcaatgacggccgaggccgtatcatgtgttgcgactgtcatcaccttgcacaccgggagatcataatccgggaaccactcatttcttagcttcccgagttcacaccccggttcagtgagcggcgcaaattgctgttccagaacagacacggcttcaagcaattcaggatcaagatttcccgttgagacgtttaaaagctgtgttgtggacgcgtttgtgatttccgttacagcttttccggttaaacaatagcctaaataatcaggaatcatcataattttgtctgtctttttcagcagctcacggtcttcttcaaacaattgatagatcgtgttgaaaggctgaaattgtattcctgttttttgataaattgcggcttttgagagggtatgttccagtttgtctattgtgtgatctgttcttctatcacggtaggagattgcttcccgcaaccgatcgcctttttcgtccagtaagacataatcaactgcccaagtatcaatgcctacggtgcagtgttcatacccaagcgtctttactttttgcagtccttgcaggatttgttttagcaaatgatcaatatcccataagcaatgcccgtctctttgactgaaaccgttagcgaacctgtgaatctcttgtatgtcaagcttcccttcattcagttcacctaccatgattctcccgcttgatgcgcctacatcaatggcagtataaatcatcctttcaccctctcttcgaaagaggaacagctgtcaccttcacctttttgtcctcaagagcttttaccgatgccggatcaagtccagaatccgtaataaggcggctgacatcttgcagcgaggcgatatgtgaaaactcgcggttcccccatttgcttgaatcggccatcaaaatggtctggtccgacctttcgatcatccgttttttgagcagcgcctgccactcatttgaatcactcatcccgttgtgtacgtcaaatcccttacatgacagaaaggttttattgacatgataggtctcaagtgaacgctctgctaacgggccggcaaatgataatgatttttccagcaaaatgccgcctgttgaaatgactgatatgttttctttattactgagttcaatagctgctttcattgagtttgtaatcacggtgagctcaatgtcagggagtattttcgccatgtaccaggcagttgtgcttgcatcgagaataattcggtctccgctttttacatatttggccgcttcgtgagcgatggcttttttttcgatgacattcgtgatttcccgttcagaaaaatgaatttctgattccttctgctgaatactgaccgctcctccgtggctccggctcagtttatgttctttttcaagcttttcaagatcacgccgaatggtttcctctgtgactgaaaatatgtcacttaattcggaaacgcggatgcttgaacgcatatttactatttccactattttttgctgccgttctgctactagcatcggtaacgcccttcctcatatcgtagtccgtcttatatttttatcatagcatatttctaacgcgtaaaagcagcagggacgccgccgtctaccgtgatcatgcaccccgttgttttttcggctttggaagaagcgaagaatgcaatggcttcggcaatatcctccgggtaaatattgacgagcaatgctgtccgtttccggtaatgttcctccagctgatccggttcaatcccgtacgccgcggctcgttcctcccgccagcttgaaccccagattgccgatccttgaagaactgcatcaggcaaaacggagttgaccctaatgccgaattctccgccttctgctgcgatgcatcttgctaaatgggtttcaagcgccttaacagagctgtaggcagaggcgttttttcccgcataaaccgaatttttcgatccgacaaataccatgcttccgcctctattttgatgtttcatctgtttaaacgcttcacgggctacaaggaaatagcctgttcctaaaacattcatattaagattccattcttttagacttgtttcgtcaaatgggcttgatgtggccagcccggcattattgacgacgatatcaatgccgccgtaagcaagcgccgctcgttcaaaagctgactgtacgtcttcctcctttgtcacatccattttgacagccattgcccgtccttttccgtatgcatcgtttatttccccggcaattttctgtgcgccttctatattcagatcagctacgatcacgtgccctccctcagctgcaaatcggcggcatgccgcactgccgattccgccggctcctccagttatcagcgctactttccgggaaaattctgcttccggcggggccagcgtgagtttatatagttcgagcggccaatattcgacatggtaggattcattttcatgtaaagaaacaaattgccccagagcggttgctcctttcattacggcgatggccctccgatataaagccccgcttactttagacatcgtataactttttcctgtattcaccattccgattccaggaatcaatatcacccgcggggcggattcaaagatttgatccccgtcctgctgattgcgtgtaaagtaagcctgatactctgatgtaaaggtctcgactcctgacttgatcagatctgcaagcttgtgcacatcttgagtttccggattccaatcaatgtacagcggaacccgttttgtgtgaacaaggtgatccgggcatgccgcaccgatttgcgaaagtgctggcgcttggacactgtttacaaattccaagacatcgtcatgatcatcataggaaaggatcattttcttttcttcacttactgctcctctgatcacaggcatgatgcctgccaagatttgttttcttttatcctccggcagcggctgataccttttgcctccgaatacctcatgctgattgatacgatcgttaatatactgctcggcttcttgaatgatggatatcgttttttgataacatgtttcagacgtctctccccaagtgactaagccgtgtttctccattaatacaagctcggcgtggggattgtttgctacgccttcagcgatcattttagacaaagtaaatccaggacggacgtatggcacccatacaaaccgatttccgtaaatgtcttcagcgatttgttttccattatccgcacagcatatgctgataatcgcatctggatgggtatggtcaacatgtttgtatggcagaaaagcgtgtaatagcgtttcaattgaagggcggggatgtttgctgtctatcatacaatgagacaggtagtctaccatttcttcatcgggcatttggtcccttttaatcagcgggcggatatcatctaatttcaaaccggaaaagttatgcgctttcattgttgccaaatccgaaccgcttccttttacccacatgacttctatttcacggcctctaaaatccttttccgttgttttcatagatgtattccccccgccccagttgcagacagtgcggtctgacccgatcagattggacctgtacaccaattcctctacacctttaggcagctgtgcagctcgctctgaatcccatatatgtttcaccatatttaatattcctccatacccttttatttgtatccgttttcattatatatgatttctgtttgtttttgaatcatttttgtttatttttgctttttaacaaaaaaagaaagcagcagatatgccgctttctcgtttcattatgattctattttaaatttcttcgtaatgtcctgaagttcttccgccatgtttgccaacgtttccgctgaagagctgatttcctccatggacgcaagctgttcttccgccgaagctgcgatatcctgaatgcctgctgagctttctttcgctactgcagaaatatcttcaacagcacttgacacttcctgtgatccggctgacagttgttcaaccgtcgcgttcaagttttgcaattcgccggaaatttgggttgtcatctcatagatttgtttaaagctttccgctgtttgatccgtaatctgcaagccttctttcacttcatgattcacggattggaacattgtaagtgaggtgctgatttccctgacaatctcttgaattaatccttcaatttccttggcggagtctgctgattgtacagcaagttttctaacctcttccgcaactactgagaaacctcttccgtattctcccgctcttgccgcctcaatcgcagcatttaatgcaagcaggttggtttgatcagcaatgccgttaatcacattcaagatgcttgtgatgtcttgcgattttgtttcaaggcccttcacaaccgcttccgctttttgaacggattggtcaattgttttcatctggccgactgtatgctccaccagcttttctccgctgcccgctgcctcagaggactgaatcgatgatttcgtaatggttgaagaggcctgagccacttttgaaatcccctcgttcatttgagaaagatgatttgagcttgtttccagtttctcgctttgtgcctcgttgccatctgagaactgttcgatggcaagtgtaatatgttcagttgccttgcttgtttgggctgcgcttgctgtcagctcctcagaagatgaagcgacgttttctacagacgtttgaataacgccgattacagaacgcaatgatgcagacatttcattaaagctttcgccaagctggccaaactcgtttttcgagtgaatgtcaatgacttctgtgagatctccgctgctgatttttgcagacgttgagacaagttttcttaacggcttggtgatggcacggataatatagagtatgagtatgccgccgattactattgatacgcatagaatgataaccgcagtgttcagcaccgggcttgaagcatcttgcaattcactgacaaaatatgtgcctgcgattttccagccagtcagtttatttgtcgtaaaggccattttcttttctttgccttcgaatgtatattcaaatgagccttcttttttggaatatacttggtttgtccaatcgccggatccggttgtccccggcttaattgtcggatgggcgatatattttttgttgccagtcgtaataaatgcaaaaccttctttaccgattttgattctttgtgatgcagtaagcacttcatccaggtttaaatcaagcgctataacccctgaaccgtcttttaattgttttgaaattgtgacaacgatatctcctgtcgcttcatcagtatacggttctgagaaaacagcttgtcctttttccgcaaccgcctgtttgtaccagtcacgtcctgtcggatcaaaacctttcggaacaccgctatccggatatttataaagcttcttatcttctgaagcagcatagattgcgcctacatcgtcgttaagtgtcgtgtactgcttaaatttctctttcagtaatgttttgtttttgcctagcaatatgtctttatcgactgtctcactataataatctattgcttttactttatcttctaatttattttgcagcgtactgtttagttcttcaacatttcccttcgcactgtttatgagctctctgtctaacgcgttccaagctgattgataactgaaatatgctaaaaccccaaccggcaaaataagcactgccagaaacgcagcgattagcggtttgctgatcgatggctgtttgatccattgtatgaattttcccattctcgttgactcctcctttaagataaatctaatatcgtcaaactaggataaaaggtttaataaaaaaactaaaaaaaacacccaagcgcaacaagcttgggtgttaaggcttattattcaattttaaatcgtttggtcatatcccgaagctcttccgccatagaggaaagggtctctgcagacgagctgatttcttccatggaagctagctgctcttcagctgacgccgcgatatcttgtatatgcgctgagctttcttttgaaatcgatgcaatgtgctcagacgctcccgaaacttcttcggagctggcagaaagctgctgaaccgtcgcactcatattttgcagttcgccggcgatttggttcgtcatttcagaaatgcgtttgaagctcatttctgttttatctgtgatgtcaagtcctgtctgcacctcttgattgacagattggaacatgccgagtgatgtattgatttccttcacaatttcgatgattaatccttcaatctcttttgctgaatctgctgactgtactgccagttttcttacttcttccgctacaacggagaagccgcggccgtactcgcctgcgcgcgctgcttcaattgctgcgtttaaggcaagcaggttcgtctggtctgcgatgccgttgatcacacgcaaaatgtttgtaatatctttcgatttcgtttccaatccgcgtacgacttgctccgcttctttaacggacttgtcaatgacattcatttggccgacggtttgatgaacaagcttgccgccttcacttgcaatttctgtcgattgaacagatgaatcagtgatcacttcagaagcttgagccatattcgtcaacccgtcattcatttgataaatgtgctctgctgccgtttcaatgttttcgttttgtttttcattgccgttagaaaattgttcaatcgccaatgtaatgtgctctgttgccttgctcgtttgcgcagctgatgcagtcagctcctcagaggaagcggcaacattgtctaccgaatcctggatggcgtgtatgagagaacgaagtgacgacgccatattgttaaagcttttgccgagctcgcccaattcatcttttgaacggatatcaatggtttccgtcaaatctccctcgctgatccgcttagaggaaccgacaagctgtttcagcggtgttgtaatcgaccgaatgatcaatgtcatgacgataatccctatgataatagctgcggccaagacaattaaagcaaggtgaaggacaggctgggctgcctcatggatttcatccaaatacatggtgccgccgatcttccatcccgtcaacttgtttgtgtcaaaggccatttttttcttatcgccatccatggtgtattgaaaatcgcctttatcagcactcaacatcttatcgagccagtcgccttttaattcagttcctgattgttcattagggtgtgcgacaacttttttgtccttcgtcatgataaatgcgtagccttgtgtgccgatgttgacttttttggttgttttcagcagattttcaatcgtcatgttgattgcgataacgcctgaaccatcttttgtctgctgggcgattgtcacaaccatcgtatttgtcgacgcggttttataagggtctgtgatcacgactttccctttatttgcaaccgcttttttgtaccagtcgcgttcaaccggattatagccgcttggcatcggaagatccggatagcgggtaaagtgcccttttgtgtcacttgtataaatggattctacatccttgttaatgctgatatattgtgagaatttctctgcaatgcttgcattgctttttgcattgtatttctcttttgtcagccattcgctgaaataatcagcactgttttctttttcgccgatgctggtgttaatgatttcgtttaattgctgtacattttccaatgcgctccccatcatctgtctgtcgagtgagctgctagccgattgatacgcaaagatcgccaatatgacaaccggtatgatgaggatcgacagaaaggaaacgagaagcttccgtgtaattgatctttgttttatgagttggagtatttttttcatcattcatttctccttttttatgctacccttcatatcggctggaaatgggtaaatatatacagcaaaaaagaagaaatttaacaaaagtaactaatttcccataaataaatagtattttagacctattatttgtctactttaaattgttttgtcagatcacggagttcttcagacattctttcaagcgtcagtgcagatgaactaatctcctccatggatgccagctgttcctcagctgaagcggcgatatcttggatgccatccgagctttccttagaaatggcagtgatatcatttgaagctgcggaaatttcttgagctcccgctgacagctcctcaaccgtcgcattcatgttttgcagctcggaagcaatttgattggtcatttgcgatatatgtttgaagctctgtttagtttcatccgtcatgacaagccctgtttcaacttctttgtttacggactgaagcacgttcagtgatgtgtgaatttcttttactatttcactgatcagcgattcaatttcttttgctgagtcagccgactgtaccgcgagctttctcacttcctcagcgacgactgagaagccccggccgtattcacccgctctggcagcttcaatggcggcatttaaagccaaaagattggtttgatccgcaatgccgttgatgacacgcaaaatattcgtgatatcctttgatttgatctccagccctttcaccacttgttccgctgcttttacggaatggtcaattgtgttcatttggccggctgttttctggacgagtgtctcccctttgcttgacacttcggttgaatctgcggatgtttctgtaatcactgctgcagcccgcgccagctctgccaatccgtcattcatttcattaatttgttcggttgtcgtttctattttctcgctttggctttcactgccgtttgaaaattgctcgatagccatcgtaatgtgctcagtggctctgcttgtctggtctgccgatgcagtcagctcttcagacgaggaggcaacgtgttctactgagtctttgatcccgtgaatgagcgagcgaagcgagtgtgccatatgattgaagctctcgctcagaacaccgagttcatcttttgaattgatttcaatcgtttcggttagatcgccttcactaattttttcagcggatgcgacaatgcgtctcaatggctttgtgatggatcgaatcacaaaataaatcgccgtcattccagctgcgatggcaattgccagaacgattgaagccatgatcagaaccctgcttgcagcatcgtgaatctcgtttgcatacatcgtgccgctaattttccagcctgttgtttcgcttgttgcaaatgccatttttttctttttgcctttgtacgtatattcaaagtccccgcttttatccttgtagagcttatcaacccagtccccttttagctctgttcccgctttttctccggagtaggcgatgactttcttgttttggctcaaaataaaagcatagccttcttttccgatattgattcctttcgcggtagtgactaagtcatcaattttcatatcaatggcgacaacgcctgacccatccaccgtttgacgggcgatggtgacgaccatttttcctgatgaaatcgattcataaggctcagtgacaattgttttgcctttattggccattgcttctttgtaccaatctcgttccaaagcattaaagtcgcttggcatgtcagcgtacggataacgtgtgaagtccccgtctttgccgcttgaaaataccgcagcgacattatcattcatttggataaattgtttaaattcctgtttcagctctgttttctttttatcctgaaatttttctgctgtagcccaatcgctgaaatatgcgaggcttttttcagtagtgctgattttatcatcaatgatgtgatctaatatctgaacattttcctttgcgctttgcgtcatctgtacatcaagtgaggcaactgctgattgataagcgctaaccgaaagggcggttatcggaacaattaagatcagcaggaaagaaataataagtctccttgcaattgatgatctgcgaatagtggtgagtgtttttttcatttccttttgaaccttctttcaataatttacaaattatatcggcggatcttcctttaaattacattgaaaatggaggaaaaaatgaaaaatagttctaaattcacctgttaaactaggactttattattgtttaccatataaaaaaacagcgctttgatagcgctgtttttcggtttttactcgattttaaattgtttcgtcagatcgcgaagctcttctgccatctgcgcaagagtcgtcgctgaggaactgatttcttccatggaagcaagctgttcttcagctgatgcggcaatgtcctggatgcttgccgagctttctttcgacacgtctgcaatgccgctgactgctgctgaaacatgctgtgaacggtctgacagctgctcgacggtggaattcatcgtctgcagcttgcccgcgatttcgtttgtcatgctgaaaatgctctggaagctttcttttgtattgtctgtgacaacaagtccggactgtacttcctgattgacctctttaaacatgtgaagagaggtgtcgatttctgcgacgatttcttggatcagcttttcgatttctttcgctgaatcggccgattggacagccagcttgcgcacttcctccgctacgacagagaagccgcgtcctgactctccggcacgcgccgcttcaatggctgcatttagtgcaagcagatttgtttggtcagcgattccgttgatgactctcaaaatgcttgtgatgtcttttgattttccttctaagcctttgacaacagcttcagcctgctgaacagattgattaatcgagttcatttgtccgactgtctgctgcacaaacttctcacccgttccggcgatttccgttgattggatagatgcctttgtaatatctgacgatgtttgtgagacttgctggagtccttcattcattaagttcagctgatgagagctggattcaaccttttcgctttgctcctcgtttccgtttgagaactgctcaatcgccatcgtaatatgctcggtggctttactcgtctgcccggcagatgcggtaagctgttcggaagatgcggccacattgttcaccgagtcctgaatagcgctgatcagagagcggagagattgtcccatttcgttgaagctttctcctagctcccccagctcatcctttgaatgaatttcgatcgtttcggtcagatcccctctgctgatcgttttcgatgattgaacaagacgttttaacggttttgtaatcgaacgaacgataaacagaattaaaattccgcctgccacaatggaagcaatcagcacgatcatgcccgttaccagcacagactttgaggcatccttaatttcatccatatacattgtgccggctattttccaaccagtcagttcgtttgtagtataggtcatctttttatcttcgttattcagagtatactggagttcaccgctgtcattcgcatacattttggctacccagtcgcctgaaagcttttctccagccttatggttcttgtgagcgacataggttttgttttttgttgcaatgaaagcataaccttcttttccgaccttgatttgtttcatttgttctaacaatttatcaatggtaatatccatggcgacaacgccagatccgtccttcagctcctgtgcaatggtaatgaccatgcttccgtcactcgcagccacgtaaggatctgtcacgacaatttcaccgccggccttcatcgcatcctggtaccaaggccgttgtctcgggtcgtatccttccggcaatttttcttttggcgcttgtacataagtgccgttatctgcgcctccataaattctggctacgccctgattaatagatacatattgtgaaaatttagctttgatctcttcttgattcgatttccctttgaatgcggatcttttaagagattcactgaaaaaggtgactgctttcgctttttctcccagatcatttgtaacagttgtattaaatgtatcgacactgtttttcgcatttcccataatttcctgatccagctttccgctggcgcttcggtaagagctaaattctaatataagaatagggataatgagaatcgcaataaatgagacgattaatttctttgaaatagacggtttcttcagccaattgataaaagtcttcatgtcacttgctccttcaggtttgatacagtatatatcggctgcttaaaaaagttttaaaataaaaaatggaagaagttctttttggctgtcttctgcctttttaactttcattgcccaagctctttgcatatcttataaaaaacaaggggggctaaacatgattattgtatcaggacaattgctccgtccccaggatattgaaaattggcagattgatcaaaatctgaatccgctcttaaaagagatgattgagacgcctgttcagtttgattatcattcaattgctgaactgatgtttgagcttaaactgcggatgaatattgtagcagcggcaaagacgctgcacaaaagcggggcgaagtttgccacttttttaaaaacatacgggaatacaacgtattggagggtttcaccggagggcgccttggagctgaaatacagaatgccgccttcaaaagcgattcgggacattgcagagaacggccctttttacgcgtttgaatgcgcaaccgcaatcgttgttatttattacttggccttaatcgatacaatcggggaagacaaattcgatgccagctttgacagaattattttatatgattggcattatgagaaactgccgatatatacagaaacaggacatcactttttccttggtgattgtttgtattttaagaatcctgaatttgatccgcaaaaagcccaatggagaggcgaaaatgtgattttactgggggaagataaatattttgcccatggtcttggaatcttaaacggacagcaaattattgataagctgaattcatttaggagaagaggagccttacagtcagcctatcttctgtctcaggcgaccagactggatgttccgtctcttttccgcatcgtccgctaaaaagccccatcgcctattttcgggacgatggggtttcaaatgccttccgttttcgatagaaaggggctgtgcctaaatattggttcgcagcccactccattttttcaaggtcatttcttgtcacgattggatctaggctgctccatttgataaagcggacaaaatagtagcctttgattggagccattgtaacttttgagtgaggccagccttcaaatacaaactcaattttccctctttttttataagaatattgaagaatgttcatatctgtcacctcagtttatcaagttacgttcggcaaagctcggtacgtttacatccattgattgactatccctcatgcaggctttcctgaaaacaaagggtgaggcgcgtgtctctttccctcgctttttatttcgcatatggacgaatgccaagcgcgccttcattcgataaagcggcagccggggcgggtgtgacaagccctccggctatcggcgtttgttcagcgatcatgcttttgtcataaaaaacagcctattatcccatcattttgatatagcatgtccgggtgcgaggcccgtcaaattcgcagaaataaatgccctgccacgttccaagaataagccggccgttttccacaatgacatgctgtgaagctccgactgtactcgacttcatgtgtgcagctgtattgccctccatatggcggtccagctcatgttcccacggatatacctcatcaaaccttctgagcatatcttttttgacgtccggatcggcattttcattaattgtaatgcccgcagtcgtatgcggacagtaaatcagcgctgcgccgctcgttatacctgtttcttgaagaaatgcttccacctcccgggtgatatcaatcatttcatctcgtttggttgttttgatttgcagtgttttcagcatttgtttctcctttcgtttgtccgctctcatcgcttaattcgttctgtgttcttttttttcctgttaaaccgctctcataaacccgataaaacaaaaaaactccagtctaaggctggagtttagcaccatagatatattcttgcttcatacggctttaagagtactgatgtcatatgcttgtgcggctctgtttcaatatttgacaagacgagtgcatctgatgacaatggcaatccagagtgcctgaacaacgccggtgttcctgtcagattggccgcaatcagtgcagtatggctctcgtttttccgaagatatgcaaagatttgctgatcttccggtacaatgagctcgtatgtcccgttaataaaaacatcatatgtttggcgcagcttgatcaagcttttgtaaaaatggtaaacggatgttttatcgtttttttgcgcctcggcattcagccatttgtaattctcattgattccgatccacggtttggcctcagaaaatccggcgtatggaccagcattccattgcatcggcgttcgcgaattgtctcttccctttttccagacaatcttcatcacatcctcgtgtgatgtgcctttcgctgtttttgtttcatacaggcgtttcatcgcgacatcatcatagtcatcaatagatggaaaagccacgttcgtcatcccgagttcctgtccctgataaataaacggtgtgcctttcatgagaaaataaacagcggaaagcgcttttgcactttctttcaggtacactccgtcgtctccccacacagaaactgaacggggctggtcgtgattctccataaacaaagcattccagccgatcccttccagactgtcctgccagtcagttaaaattcgtttaaatgcaacgatatcaatactttcattgatctctacatcccacaggccgagatgctcaaattgaaaaatcatgctgaatatgccgtttttttctccagcccaatcagctgcttcttttgcagcgacgccgtttgcttcaccaactgtcataatcggatagcgggaaaatgtgttttccttcagctctgttaacaaatccataatgccgtcagcattcatatgataaggaaaggaagggacatagtccagcccctttggattcggcatgtcgggaaacccttcttttttcttaatatgcgtaatggcatccacccgaaatccgtcaattcctttatcaagccaccaattgatcatgtcataaacagcattcctcaccttttcattttcccaattcaaatcaggctgttttttatcaaaaaggtgcagataatactggcttgtcttttgatcatactcccaagccggcccgccgaaaatgctttcccaattgttgggcgtttttccgtttttgccgtctttccaaatataccagtcgcgcttttccgagtgtatggatgaacgggattctatgaaccatggatgttcgtcgcttgtgtggttcacaacgagatccataatcagcttcatatccagatcatgaatgtcaccaagcagctcgtcaaagtcttccatcgtgccaaactcgcttaatatgttttgataatcccggatatcatagccattatcggcattcggtgaatcatacagcgggcaaatccatatgacgtcagcgcccagctcttttatgtaagaaagcttggatctgattccttgaatatccccgattccatcgccatttgaatctttaaaactgcgggggtaaatttgataaacaacggcttccttccaccaagcctttttcatacagccactccttcccagtgtccatcttatatatcctatgtagaaaaaaggcttcacagcattgctttttaagaaatgacttgatgacacaaaaaacagccgttcgttccccggctgttttttattaaaaattagtttttttaatttctacaaaacggatgtgatgatcttcggcgtcgaggattttaaattcacagccctccgcgtgtatcacatctcctgctttcagctccattttttgcgttagaagccagcctgcaatcgtatcaatttcttcattttcaatcgcaatgtcgagaaggtcattcacttcgtctattagcgcttttccatccatcacataatggtgctcgccctttttcaggatgtgcggtgtttcatcctgatcatactcatcgcggatttccccgacgatttcctctataatatcctctacagtgacaagccccgccgttcccccgtattcatctacgagaatcgccatatgaatccgctccttctgcatgcggattaaaagctgctgaacaggaatgctttcaatgactctgataacgggcctcatgatttgattcagctttatcggctggccgagaaaataagctttaaacatatctttgctgttgatgatccctaaaatatgatccttgtcatctttgatgacagggtagcgtgtataccgttcattaatgatgtgatgaattgcctcttcaagcgactgctccagagagataaccgcaatttctgtccgcggaatcataatctctctcgctacccggttgtcaaattcaaaaatcttatttacatagcggaattcagactgattgatttctcccttttcatagctttcagaaaggatcagccttagttcctcttcgctgatgacaacctcatgctcctttactgaatgaaagccaaacaatttcacaagaaagcttgcagagccgtttaatgccttaataaacgggtacgtgattttataaaaccagatcagcggctttgcaatccataagcttacagcttcagctttttgaatagaaaccgttttcggggcaagctcccccatcaccacatgcaaaaaagtgacgataataaatgcaactacaaatgtgacaatgtgattaaacggttccggcatgcctgtcattgtaaataagggatgaagaaaacgttcaaatgtaggttcaccaagccatccaaggccgagggcagtaatcgtaatcccgagctggcaggctgataaatactcgtcaagattggagatgattttatgtgcggctagcgctcggctgtcaccgctttcgatgagctgattgatttttgaacctctgattttgacgatcgcaaattccgctgcaacgaaaacagccgtaatgccaatcaaaacaaaaatggcgatcaattgtaaaataagcaaaaaaagcccttaccataaatggtaaggggccacctccttaacgttaattctcatcacgaccgtttaagaaaatcatcacaaaacgaagtagttcaaacagggaaaccagggcggcggccacatacgttaaggcagcagcgctcagcactttatttaccccattttcttcattgtttcggatgaatccttctgacacaataatctgcttggcgcgtgaacttgcattgaattcgacaggcaatgtaatcagctggaaaaagactgccgctgaaaacagtatgatgccaagcccgatcaaattcaggctgccgagaagcatgcctcctaagaaaagcaaaggagctacaccggatgcaaaattcacgactgggaagattttatgtctcagcacaagcgcaccatatgactcctgatgctgcaaggcatgtccgacttcatgggaagctacggatatggcggaaattgagcggccgtaatagaccggctcagataaacgcaccacccgtcttgtcgggtcgtaatggtctgttaaagtgcctcttaccggttcgaccggcacgtcgtaaagaccgtttatatctaaaatccgtcttgccgtttctgcccctgtacgtccgcttgaggcttccacttttgaatatttttcaaagttgctctttactttaaattgtgcccaaaacgacaatcccaatgcggctattgttaaaaatataaacagcattttttcatcatcctttttccatgatcatttctctattacgattattttaatgagttttctttcccgtgtacagaaatgcgctttttcttccggcttggagcacagaatccaatcagcaaaaagaacaggcctgctgaaaacaaataaaaggcgaaaccgccggccagttctttcagaaaataaaaccaggagaagctgccggaaaagtgattatatgaattcaaatcgaaaataaacaaaatcaccgcggatgccgccagctgtgtaccgatcaaaaccacgatcgttctttgaaagatcgtcatctttttcatcctttttgttttagtttatggagaaatccggttttatatgttttgtacattttttgaaaaacatcaccggaagtgggacatactgttagaaaaaagcacgggtgtgatggaagctatgaaagtgacgagtgaggaaaaggaacagctgagcacagcaatcgaccgaatgaatgaaggactggacgcgtttatccagctgtataatgaatcggaaattgatgaaccgcttattcagcttgatgatgatacagccgagttaatgaagcaggcccgagataagtacggccaggaaaagctaaatgaaaaattaaatacaattattaaacagattttatccatctcagtatctgaagaaggagaaaaagaatgaaatcaaatcggatatttatttcatggctcaggtggccgttatttatccgaatcggggttattattttatgtctgattcttttgttcggccaaatcatttatatacttgagcctaagcagttcacttcggtattcgaaggcatttggtgggctgtcgttacggtttcgacagtcggttatggagactatgtgccgcacacgccgctgggacaggcagccggaatactgctgattttgagcggagcaagctttgtcacagcatatttcgctacgttatcagcggccgcattcagcagacagcatcgctacatcgaaggaaaagttgcttacaaaggccgggaccacatcattctgatcgggtggaatgaaaaaacaaaccggcttttgaaggaccttcagcttgccgccccttccaaaacggtcgtactaatcgatgaatccttaacagaaggcccgcttattgaaaacgttcatttcatacgcgggcacgctgccgatgatgggacactgaaacgggccaatattactgaagcggaatcagtgatgattactgccgatcagtataaaagtgaaactgatgctgatatgctgtcagtgcttactcttttatctgttaaagggcttaatccccttgcttactgcatcgtcgagattttgactgaccgttttgtcaccaatgcggagcgggcaggtgcaaaccaaatcatcggaacttcagaatttatcagccgggcgatgctgcagcattaccaagtcaagttacggccgtctaaacagcagaacggaatcaagctgacacttgatcagcatgtggagcttcttgctgttcctgacgaactaaagggagcggcttacaaaacctgtgttctctatttccttgatcacaacacaacaattataggcgtacaaaaagaggaggggccgatgatttcccctcctcttacatacaaggtgctcgaaacagatcaattccttgccatctagtgtaacagaacatcctccaattctttcacgagagaggcgccgatatccaaaaatgccggatcaatttccgcgtcccgcctttccggttcggaaaattgattaaacagtgattggaaaggccctccctcggcgtgatcgtcaacatccgcctgaaacacctgtctcagcataaacggcgttccgatccggacggccgcccctcgttcatcgagactgccctgtaccgcattgacgggaattcttaaaaataaatagccgtctctatcatcaattttataatcaaagtagccatgatcgtattcccagccgccgtttatcacataaccgagcggcttcatcacttgttccagttcttgaagcagaaaagactgcccatctatcgcggaaggtattggtatcatcagaatgccccttttttcacttatcctgtcctgccgaacaagacttcattcagaggcgcctacatggaaatcgttgtttctttcgcgcggccaacaggaaagaaagcgcattcaattaagaagtaaacagtcattgccgctgcaagccatacagctgaatcccaagacacataaacaaccgttgcatagagtcctaatttagtgaaaagagtatgggttcgttttaaatgcaaaatccgatgtaccgcatcggtaaaaagggcaagcggcaaaccaatgagaagaaaggcgtggatgaaaaaatgtgacagcgtgccgccaaagcttgaagaaaactctgtatacacggcatcaaaggagataaggaaacttaaaatagctgcagaaaaaccggcaatgatgagatgtttaaccaattgtttcatgaacatcagcacctttctgattttataaaaagccgaccggcaaatgccagtcagctttctcacattaatcttccagacgtttttcaagctctgcttttttctcttcaaagccaggtttgccgagtaacgcaaacatattgactttatacgcttctacaccaggctggtcaaacggattgacgccaaggaggtaaccgctcatcgcgcaggctttttcgaagaaatatacaaggtatccaaaagtatatgcattcagctcaggaatgttaacgattaagttcggaacatttccgtctgtatgggcaagcatcgtgccttggaatgctttcttattaacgaaatcaacagttttaccggctaaatagttcaagccgtcaagatcgttatccgcttcctcaattgtcagttcatgtttaggtttctctacgttcaggaccgtttcgaataaatctctgcggccttcttgtacatactggcctaaagaatgaaggtctgttgaatagttcgctgaagaaggataaatgcccttctcatctttcccttcgctttctccgaacagctgcttccaccattccgcaaagtattgaagcgccggttcgtagttgatgagcatttcaattgttttgcccttattataaaggacattgcgaacaaccgcatattggtatgctgggttatcttccagttcagatgttgcaaaatctttgctcgcatccagggcgcctttcatcatgtcatcaatgttgacgccgctgacagcaatcggcaagagacctacagctgttaaaactgaataacggccgccgacatcgtcaggaataacgaatgattcaaagccttcttcgttagaaagcgtttttaatgcgccgcgctctttatcagttgttgcataaatccgcgctttcgcttcttctttaccgtatttctcttcaagaagcttgcggaaaatacggaaagcgattgcaggttcagttgtcgtacctgatttagaaatcacattaatagagaagtcaacatcttcaagaagatccatgacgtctctcatataagatgaactgatgttgttcccgataaaaatgacttgcggattgccgcgttttgcttttggcaaagtgttataaaacgcgtgattcagcgcttcaatcgctgcccgcgctccaagataagaaccgccgatgccgacaacaagcaagacatcagagtcagatttgattttttccgcgctttttttgatgcgcgcgaattcttctttatcataatgttcagggaggtccacccagcctagaaaatcgctgcccgcgcctgttttctcatggatattatggtgtgctgtttttacaaagtcccgcaggtatgtaagttcatgttcgttgaagaaagtcaacgcttttgagtagtcaaagcgtacatgcgtcattgcttgtccctccataacggtataatgttttcatctttcactttatatgaacttatctgtgaaatcaagtcaagaagaaagggcggaatgactggattccgcccttttggattatagagacgcgcgaaggatggcaagcacgtcatctttgttcagtttttggaagttgccgaagccgccgtgttccatttccttggctgcgatatcagcaatcagctcaagcttttcttctccaatattataatcagcaagacgagaaggtgcaccgaggcttgtccagaacgcagacagtttatcgattccttcaagcgcaatttctttatctgttttgccttcagtatcaatgtcaaacatgttgagcatgaggtttttgaagcggcctacatttgtatcaagcgtgtatctcatccaatttgggaacagtattgccaaaccgcccgcgtgcggaatatcatatacagctgaaacagcgtgttccattgtatgagaagcccagtcaccgaagtatcccatttggagcgtgccgtttaaagcaatagtaccagcatacaaaatcgtttcacgaagttcgtagttttccagatcttcaagaagcttaggagctgtttcgatgaccgtctgcaaaacagcaaagcacattctatcctgaagcggcgtgttttcaacattatggaagtattgttcgaatacgtggctcatcatgtcaaccatgccgtatactgtttgattttctggaacggtgaacgtattttcagggtctaaaatagagaaacgcggatgagtgacattgctgccccatacaaatttctcgtttgtttcccagtttgtaatcacggaatcagggttcatttcagaccctgttgcagcaagcgttaaaacagtgccaaacggcagcgcatcctccgctgttacttttttgctgaaaatatcccaagcgtcgccatcgtatttgacgccagctgcgattgcctttgtacagtcaatcacactgcctccgccgacagcaagcagaaaatcaatgtcatgctctctgcaaaggcctatgcctttttccactgttgcaagacgcgggttcggctctacacctgacagctcatgaacaacagcgccctcttcttttaaaatgcctgtgacttgatcataaaggccgttgcgtttaatgctgccgcccccgtaaacaagcagtacatttttgccgtatcgtttgaattcttttcttaattgttcaagctgaccttttccaaaaatcagctttgtcggattataataagtgaaattttccatagtaaaacctccaaatgatgctggtgaaaaacagattttccattgtaacataagttgacaaaaagaaaaagggaagcagccaaacggctatttccccttttttatagagatgctttcaaaattgacagcacatcttctttgttgagtgatttaaattggccgaatgtaccgttagccattgccttgtcagcaattgtgtcaagctgctcatcattaatatcataatcagcaagacggttcggagcgccaaggcttgtccagaatgcggacagcttatcgataccttcaagtgcgatttcttcatctgttttacctgcttcttcaacatcaaacacgcgaactgcaagctgtttcatgcgggcagggttttcagacaatgtgtgtctcatccaattcgggaacagaatcgccagtccgccggcatgcggaatatcataaacggctgatactgcatgttcaatattatgagtagcccaatcccctcttgcccccatagaaagcatgccgtttaatgcgattgttcctgtgtacaggatcgtctcacgcaattcgtaattttcgagatcattgatcagcttaggcgctgtttcaatgactgtacgcaaaagtgattcacacatgcggtcctgatacggcgtgtttgatacatgatggaagtattgttcgaatacgtggctcatcatgtcaaccatcccgtagatcgtgtggtttttaggtacggtgaatgtattcaccggatcaagaatcgagaatttagggaatacgagcgggctgccccagccgtatttttcttttgtttcccagtttgtaataacagatcctgagttcatttctgaaccagttgcagcgagagtcaataccgttccgaatggcaaagcatcttttggctgatgctttttcgtaacgatatcccacgcatcaccatcatacttcgctcctgcggcaatcgcttttgtacagtcgattacgcttccgcctccgacagccagcaagaaatcaatgttttgttctttacagatggcaacacctttattaacagtcgacacacgaggattcggttccacacctgctaattcatgcacggtagctccggctttattcagctgttcaatcacttgatcatacaggccgctgcgtttaatgctgccgcctccgtacacaagcaatacgttttttccgtaaggtttgagttcctccggaagtctttccacttcgccgcgcccgaaaattaatttggtcggattccagtatgtaaagttttgcatgacatctcctccttagattttttattatgcagaatgtcctcaccacatgtaaagcaatcagctctcaccgatcagcataccagatggttttattttgcaaggtgctgggaaagaagctgatataagcgagggcaggccagcttccctcatatggagaatgcatgtatagattctccaatatgtcacaatctataactgttttaataattcatggaggaggttgcaaaacatgagtaccattcaaagaatttgtcttgtattaaccatcattggcgccattaactggggactgatcggatttttccaatttgacttagtagcggctatcttcggcggccaagggtcagctctttcccgaatcatttacggacttgtcggaatcgccggcttaatcaacctcggtctgctatttaagccaaacgaggaaagatcacgtgaagaagcagcaaatcctgaaatgcgataggatatcaatcacgctgaaataggattttgcatgaaatcaaaagcaccgaacattcctgtccggtgctttttttcatgcttattttttgataaggtctttgcggttggacatttcgatccactcttcaagcttatcttttaatgtgttgaaaccttgtggtgtagaagcttcttcgcttacttgagcagctttaggttttcttggtttgctttcttttttctcaggcgcagcttgtgtcgcacgaattgaaaggctgattttgcctttttcttcatcaacagcaagtacttttacttgtacttcgtcgccaactgaaaggtgctcgttgatatcttttacgaaaccgtgagtcacttcagaaatgtgtactaaaccttgagtttcttcatctaatgcaacaaacgcaccatacgcttgtaatcctgtaactttaccagtgtaaacactgcccacttcaaattttgctgccattcataacaactcctaagttaaattaaatatctgtttatacgcaatttaaaattatatcacacatgtcttatttccgcaaagaaaacttttttataaaaaatcaggtttatgcacagcaaaaagggggtaaactgaaaataccaaaggctttctagtattccccccttttattggatgcgaacaaaaggttcgtatctttttttatgttgttttgtgcaggaagcgtttcattctgactaacgcttcttgaagctgttcaatcgaggttgcgtatgaacaacggatatatccctcaccgctcggaccaaacacacttccaggaacaacggccactttttcctgcgtcagtagctcctcggcaaactgttctgaactcattcccgtgcttttaatagatggaaaagcatagaaagcgccgcccggatgatgacagctgagaccgatttcattgagcgattctacaaacagattccgtcttcttcgatagctttttttcattttttctacgtcttccatgccgttcttcaggccttcaagggcggcaaactgcgccattgcaggcgcgcacatcatcgcatactgatgaattttaagcatggcatcccgaagcaaggatggtgccgcggcaaaaccgagcctccagcccgtcattgcaaatgcttttgaaaagcctgagatgactaccgtccgttccttcattcccggtaatgccgctatacttgtaaattcctcatcatatgtcagctccgcgtagatctcgtcggctaagacgatgacatcatgttttttggcaaactcagcaatctcattcagctcttccttcgaataaaccgaacctgtcggattcgatggtgagcagatgagaatagcctttgttttttcagtgactgccgcttcaaaatcagcagccgttgctttaaatcctttgtctgccgttgtatgaacgtgaaccgggataccgcctgccaaagaaacaagcgcatcatacgccacaaaacacggctcaggaatgatgacttcctcacctggattcacaatggcgcggatcgcaatatccaaagcctgacttgcccccactgtcacaatcagctcattatctggcgagtagctaagatcaaacctgttgctcaaataacggctgatttcctcccgcaatgagtataaacccgcattggccgtgtatgacgtatatccttgttcaagagagagaatgcttgcttcgcggacattccacgcggtaacaaaatcaggctcgccgacgcctaaagaaatgacgccttccatcgttgccgccaaatcaaagaatttgcggatgccggatggttttatttgttgtacatagtctgataaatacgaagtcatttacggtgacaccacgattcttttgtcgtcgtctcctgtttcaaacactttgccgtcatgcttgtattttttcaggataaaatgggttgtcgtagatacaactgaatcaagcgttgagagtttatccgaaacaaaacgcgctacgtcagacatcgaattgccgcgaatcacgacagacaaatcgtatacgcctgacatcaggtaaactgattcaacctcttggaatcggtaaatccgttccgccacttcatcaaaaccgacgccccgcttcggcgttactttgacgtcgatcatggccgtaacgccctcatgtccgtctacttttcgccaatcaatcatagcggaataatcgataataaccttttctttttccagtttgtcaataattgtttttacttcatttacagggatgcccgccatctttgcgattgtttctaaatcggcgcggctgttttcgtctaaaatttctaatatttctgtttctttttctgtcagtttcatttgattcacacctttgcaatgtcaagaaatctcatgacattatatcacgttttttgacgaatgctaagaaaaaacgaggagaaacttccgctagaatttacaatttcagggcataatacaaccatcaaaaaaagggagtgacacagaatggaggcggtttcaccaataaggcggtttacggtcgatggagtcaatgtatactacgaacattatcaaaatcccggcaggcaaacgctggtttgcgtacacggttttttatcatctgcattcagcttcagaaaagtaattcctctccttcgggacaagtacgacatcatcgcgcttgatttgcctcctttcggccaatctgaaaaatcaagaacgtttatctatacctatcaaaaccttgctaagcttgtcattgggattttggagcacttgcaagtgaaacaggctgtgcttgtcgggcattctatgggcgggcagatatcgctgtctgctgctctccaaaaacctgagcttttttcaaaggttgtgctgctttgcagttcagggtatttaaaacgttcacacccgacgatcattttcgggacccatatcccgtattttcatctttatatcaaacgctggctctcgaaagaaggcgtgatgaaaaatttattaaatgtggtgcatgacaaatcgctgattgatgaggagatgattgacggctatggcagaccgtttcaggacgagcagattttcaaagccatgacaaggtttatccgccacagagaaggagatttagaacccgagcaattgaagaaaatgaacaagcctgctctattgatttggggcgaggaggatcgaattgtcccaatggagatcggtaaacggctgcacgcagatttgcctaattccgtgctgtactcacttggccagaccggacatctggtgcctgaagaacggcctgaacttgtttctgaacacattgctgattttatcaattaaaaaaaccggtgctgaaccggtttttttaaggcgtgcaggagctgctgtttttaatgaataaaagctggccagccacttcccggcagctgtcgatcggcagcgtttgttcaaaagaagtttcaaatatttgctgaatgcttttcgccagcacgtcaggatcgtcttcatcatagactgcctgcacgacatcaacagcctccgtttcgtaaaactcttctccatatttaaacgggtcccatttggcaatgatcttaatcatttccctgaccgcttgactttcttccatattcatcaccgcttataataaaatttgcagttctatcttatcatagtgaagcttagaagaataaacatacatgagggggtaacagaatgaactttgataaacgagaagaacgccttggcacccaatcggtcaaatgggacaaaacaggcgaattatttggcgtgacagacgcactcccgatgtgggtggcggatatggattttcgcgcgccagaagcgataactgaagcgttaaaagagcgtcttgaccacggtatttttggttatacaactccagatcaaaaaacgagggatgctgtgtgcggatggatgcaaaacaggcacggctggaaggtgaatccggaaagcatcacattcagccccggcgttgtaacggctttgagcatggcggtacaagcttttacggagccgggcgatcaagtagttgttcagcctccagtttatacgcctttttaccatatggtggagaaaaacggccggcacattttacataatccgctgctagaaaaagacggcgcatatgcaatggattttgaagatttggagacgaagcttagtgacccaagtgttacattgtttattttatgcaatcctcataacccttctgggcgttcatggggccgggaagacttactgaagctaggcgaattgtgccttgagcatggcgtcacagttgtatcggatgaaatccattctgatttaatgctgtacggacacatacacacgccgttcgcttcgctctctgacgatttcgctgatatttctgtgacatgtgctgctccaagcaaaacatttaatatcgccggattgcaggcttcagcaatcattattccggatcgcctgaagcgcgccaagttttccgcaagccttcagcgcaatggtttaggcggactgaacgcgtttgccgtcactgcaatcgaagccgcgtattcaaaagggggaccgtggcttgatggattgatctcttacattgagagaaacatgaacgaagcggaagcctttttgagcaccgagctgccaaaggtcaaaatgatgaagccggatgcatcatacttgatttggctcgacttcagcgcttacggcttgtccgatgcagagcttcagcaaagaatgctaaaaaaaggaaaagttattttagagcccgggacgaaatacgggcctggcggagaaggatttatgcgcctgaacgcgggatgctctcttgcaaccctgcaggacggcctgcgccgcatcaaagccgcattatcgtaaatatagctgtaaacgcctttacgtcttcatttgtaaaggcgttcttaataaaggaattttatattttacttctaatatttagtgttataatagattcatattttatacgaaaggatttcacacgaatggaaattctaaaagactatcttctgcacatctgctttattttgtttcctattcttctttaccaagtgttttggcttggaaaacctgcgattcttgtgccaaaaataaacagcggtttggtcacgctcttcgcctgcggcgcctccgttttatgcattattttcccgattcatgaaatggactacatacaatacggccttcagatgattcccgttatcatttgtttattttacattagtaccgcttccggacttacagtcgccgcatctgtcctatgttttgaactgcttttttacgaaccttccgcaatgtttgttttcactttgctgccttttcttatcattatcccaatcttatttcagaaaaaatggccattcatgtccaaagcgaaaaaactgctgctgtctttattgatcagctgcgtggagattttcctatttttcgcctcaagctggattctttccgccttgaatattttaaattttcaaaaatcaggaattttcgtttacgaggcggcagtctcagggcttttccgctccagtgttcttctattaagcatctatattatcgaaagcatcgccgaaaatatcgccctgcgctcacagcttatccattctgaaaaaatgacgattgtgagtgaactggcagcgagcgtcgcccatgaggtcaggaatccgctgacagttgtccgcgggtttgtccagctgctttttaatgatgaaaccctacaaaacaagtcgagtgcagattacaaaaagcttgtactgtcagagcttgaccgggcgcaaggcattattacaaactatctcgatatggccaaacagcaattatacgaaaaagaggtttttgacctatcagcccttatcaaagagacaagctcccttatggtgtcgtacgccaattacaagtcagtaaccgtcgaggctgaaacagaaccggaccttttgatatacggagacgcaacaaagctgaagcaggctgtcatcaacctgatgaaaaacagtattgaagcggttcctcacgggaagggtgtgatccacatatcagccaaaagaaacggccatacgattatgattaacatcacagacaatggggtcgggatgacagaccatcaaatgcaaaaactcggcgaaccttattattccttaaaaacgaacggaacgggactcggcctcaccgtaaccttttccattattgaacatcatcacgggaccatttcatttaacagcagcttccaaaaaggcactacggtgaccattaagcttcccgctgatcttcctcactagcaaatcgattggaactttaatagaatgaatgcgaggtgatgacagatgagcacgtttgagacaggctctatcgttaaaggattttacaaaacaggtgtatacataggagaaatcacggcttgcaggccgcagcactatttagtgaaagtgaaagcggttcttacccatccctctcaaggagaccttcatcatccaaaacaggcggatgtgccattttttcatgagagaaaagcgctcgcatatggtgaacagaccaatatcccccaccatatggtgaagccttatgacggtgaagtgccggattataccgaatctctgcgggaggcgacagcacagctgagagccaaattgaatgaggatggttcggagtgggcaaaacgctcccttcataatctggacattttagaaaaagaatattttaaccggccataacccagtctgacaaaagattgggtttttcacgtcgcgcgcttgaacagttcggttaaatcgattctttcgccgattgtgggcggtttcggcttttcgagatactgcttatcctgctcaacaagcttaaaaagtttatatgctgtgagggcatcatcaagcgctttatgatgggtgccggttccggaatctccatactcttcggcagctttccataaacccgtcaatgtccggtctccaaaaaagtttttgtattcaagcgataaatctctcatttctcccttaaacgggaaagggatatggttaaacatacagttttgcttcagcactttcatatccatgtttccccacgtaataattgtgctgtttttctcaggatccagctcgtttagtttacggatgaaatcctcgaatctcattccttcgtctacctgtttttgggttatttttaaaaatgatttgcagcgtttcgtaagcttcgggaactttttcggtctaacatagctagaaaacgtctcaaccacttcatcatcaatcgactttacaattccggcttcaatgatttccgggaagaagttttgaggactgtactttccatcaggcatcgtaaattcgaaatcaataatgagtaagctgtttgtcgtcacctttttacacctgcctttcctccgatcagaaaatgctatctttatagtatatcaattccccttctcgacatttcttcattttctaaaaataatgaattttcccagccgcttcgtttcttttaaattatgaatcgtttctttataattagtaaggaacccgaaataataagaaggtgatgttatttctatccgtaagaaaaactttgtcatagtgtggctggcgaacttttttgtctccgctagcacaacgatgatcgttccttttctctccttatacattgagacgctcagctctttttcaaacggctttgtgcaaaggtggagcggctatgtgttcggcattacatttctcatggcgtttttggtatccccgttttggggacggttcggagacaaacgcggatacaagaaaatccttatggcaaccggaacgggcattgccctcagcattttcttcatgggctttgttacatcggtgtaccaattgttttttctgcgtatggcaatgggtcttgtaaccggattcatcccgacttctcttgcgatgatttcggcacagactccgaagagctcagccggcaaaacacttggcacgctgcaaatggggcaagtgtccggaagcttgttcggcccgcttttgggaggcatgcttgctgatcgtttcggctttacgtataccttttttatcacatcctttgtgattttctcgtctgttcttctcgtgttatttggtgtcaaagaaaagcctcttgcagagaaaacagccaaacgtacgtcttactcgagaaaagaagtgctctcctatatttttcaccagcccgcactgtgggtcatgatgctgttaaccatgctgattcaaacaggcaatttcagtatccagcctctgctcgctttatatgtaaatgagctgcacggacctgtcaatcttgcctttttctccggcatggcattttcagcaacggggctcggaagtttgctgctggctagaaaatggggtgatctgggcgaccgctacggccatcgccgcattttaatcggacttttgctcgccgcctctttcttttttattccgcaggcgctcgcgtcctcactcagcgtgctccttgttttcagatttttattcggaatggcgatgggcggtttgctgccatgcattacggcagcgatccgcgttcaggctcccggcagcattcaaggtgaagttctcggctacaatgtcagctttcgctttttaggaaacgtgctcgggcctctgctcggcggaatcatatcgagccattttaccatttcggccaccttttacgtcacggcgtttctctttttcgccggcgcctgcatgctttggatcatgcagaaacttcggaaagattcttatgccaaagcaagctgattccgagaaaaaactgaggaatcttctaaatttaaccttctcgtaatctcaaaagaatggtacgatatggctagaatttaggagaaaagagagtgaccatgttacgaaaaataatcggatggattttgctcctttgcataatcccattgtttgcatttacagttatcgcttccggaaaagaagtaaaacaaatgaagtccctggatcaggtgcttgataaaaatattgatctgaaagatatcagccttgttcagaacagctacatgtatgacagggacggctcccttgtctcggaaatcgttagcgaccacgaaaaccgtgtgctcgttccatttaacaagattcccgaggaagtcaaacagattttcttaacatctgaggaccgccatttttacgagcataaaggctttgactttatgggaatggtgcgggctactgcttctaacgtaaaagacaagaaaattgaccagggtgccagcaccatcacacagcagctttcaagaaacttgtatttgagccacgaacgctccttcagccgcaagctgacagagctcgcgtattcctatcagctggagaaaaaatatacgaaaaatgaaattcttgaagcttacttaaataccatttatttcaacaacggtgtttacggcgtcggttcagcagctcaattctatttcagcaaaccgctgaaatctctcacagtgggagaaatggcttttatctgtgctatacctaataaccctacattatatgatcctctcaagcattttgactacacgaaaagccgtcaagaacgtttgcttaaagggctaaaagatgccggggtcattacggacaaagagctgaaaaaagccgtaaaacaaaaaatcaaactggatgttgaaaaaagagaagacaaatatcctgactacgtttcctacgtcaatgatgaattcactcagctggtgtctgaatcagaaggctttgataaacgccttcaaaaagcatcaggaaaacaaaaagaaaagatcgagaacgagctgtccgcaagagtcagcacgctgatgaaagacggtgtgaaaatttatactgcacttgatccgtacatgcaaaatcaagttgtggcacaaatgaattccaagctcccgtatgcggacgtacagggcggagcggctgtgattaatcaccagacgcatcaaatcatcgctctatccggcgggaaaaactatcaaaaatatgactttaaccgcgcctaccaggcgtacaggcagccgggttcatccattaagccgcttcttgattacggcccttatattgaacagaccggcgcgacaacaagcagcaccattgatgccagcaagttttgcagcaaagactactgtccgcaaaactacaataaccgcacttacggcacagtgacgcttgatacggcgtttaaaaattcatataataccccagctattagaatgctcgaccgcgtcggcatccaaaaggcattcagttatattgagccttatcattttgccaaacttgtcgacagtgactatcttcttccggcggcgcttggcggatttacaaacggcatgacgcctcttgagatgacaaaggcttatacgacattcggaaacagcggaagctatacgccgagccatgcgattacaaaggtgacagaccttaaaggaaaaacgctttataaatggaatgataaagcgactcaaatattcagcgtccgcacgaacatgcagctgaaaaaactgatgtcttccgttgtgaaaagcggaacagggaaaaaagcatatttcaatgcgccttacatcggcggtaaaaccggaacatcaaatgattatcacgatatgtggtttgtcggcctgactgatacgtatacaatgggtgtctgggtcggaaaggatacaccgaccagcgttgaatatcttcacagcatcagccctcagctttccatctggaaaggaacgctgcaagcggcttattaaaggatcggaggggatatggggtgacttcagaacaaattccaaatcgcgttttgctgtttgacggtgtctgcaatttatgcaatggcgccgtgcagtttattattaaacgtgatccggacggattgatttctttcacatcgctgcagtcggaaacaggacagagcctgctgaaaaaaagcgggcttccgactgatcggcttgacagctttgtctttattgaagacggtcaagtgtacacaaagtcaactgcagccattaaggttttcaggcatctgcgaggcccatggcggctcttcgtcctgtttttcgcagtgccgaagcctgtcagagatatggtctattctttcattgccaacaaccgctataagtggtttggcaaaaaaaatgaatgtatgctcccctccccttctattaaaaaaagatttttaccgtaaataaaaaatggctaggaagctagccatcacagattgttgacaaaatcctaaaacgacttcgttttaggattttgtcatcttttcagcgtgattgaaaacttttgaagtcgatgaagagcgagcattggatgtgaaacggcggaaacctgagaatctagccgccgttttattgcgtatagagcacgaagcgcaaatctgaccaccaaacgctgaaatggctagcttacacaggtaagctagccattatgctattataaagcttgataaatatgaacagaataccgataacaaaggtaaaccaaaacagcagttccaatagaatgaacccgactaatgacatgagagaaagcgtcgaataaatccggtatacggtaaacacaaagtaagcgagcgtgacgaccgcaaaccagatcacaatccaaatgacattttgcaagagcacaaaggataaaatcccgccgcccaaataaatcatggaacccattctgagttttttcaggttgttcccttccggatcattagcaaaaaacagcaatgacagctcggtcacggtatttgcaattaatttcagagcggacagaaccataaaatataaaagtgcaaaggcagcaaataacgcaagcctgattcctttctctgaaaaataatcgagcattccatcatacattccaaatgaagacagcatcttcaacgcataaagtgaagttgagatggataaggacgaactaaaaagcaggatcgcaatcagcggaaaatatcctgtcaaataagtatttttcatataaaaaagtccctttctataatctacctcatttattatggaggacttaaaacacattgacaagataaattattccattttttctcctttttacgaattacggtcccaaatcttcacaaagcagcattttgagagtaaagtagtacgcaggaatcataaaacgtaaggaagttttatatgaaaaaaacattaaaactgcaaaccagactcaccatatttgtttgtatcgttgtattaatcgcattgctcattacgttttttacagtcggtgcccaaaccaccaaacgaattagagatcaggaaaaggccactgcgctacagactgctgaaatggtagctgaggcgccgatgacagccgctgctttagaaagcggaaaaaaacaaaaggaactgcagagctacacaaagcgggttcagaaaattaccggcacggaatttgttgtcgtcatggatatgaacggtatccgcaaaactcatcctgacccgagcaaaatcggaaaaaaattcagaggcggtgatgagtccgaggtattaaaagggcatgtccatatcagcacagcctctggcacgctcgggaaatcgcagagagcgttcgtccctgtctacgcggagaatggaaaacaggtcggtgcagtcgcggtcggcatcaccgtaaatgaaattgatgaagtgatcagccatagcttacggccgctttactttattatttgcgtcagcatcttcgtcggtgtgatcggagccgttatcgtcgcccgtacagtgaaaaatatcatgtacggacttgaaccttatgaaattgcgactctgcttgaagaacggagcgcgatgctggaatcgacgaaggaaggaatactcgctgtcgatgaacatggcaaaattaaacttgccaacgcggaagcaaaacgcctattcgtcaaaatgggcatcaacacaaatcccattgatcaggatgtagatgacatcttgccgaaaagccgcttgaaaaaggtcattgagacaaaaaaacctcttcaagacagagacgtccgcattaacgggctggagcttgtgtttaatgaagttcctatccagctgaaaggacaaactgtcggagcgattgcaacattccgcgacaagaccgaggtaaaacatttagctgaacagctttccggtgttaaaatgtatgcaaacgcactgagagcgcagtctcatgaatttatgaacaaactgcatgtgatattaggtctcgtccagctgaaagagtatgatgatcttggagattatattaaagatatagccatacagcaaaaatcagaaacaagtgaaattataaatgatgtcaaaagctccgtactggccggttttctgcttggaaagcaaagctttatacgtgaacagggcgcaaatcttgatattgaatgcaacggtgtcatcccgaacgcggcagacccttctgtcatccatgaacttattacaatcatcggaaatctcatcaacaatggcttagacgccgttgccgatatgccgaaaaaacaaatcaccatgtccatgcgcttccataacagcatacttgatattgaaattaccgatactggagcaggcatgtctgaagaagaccaagccaaagtatttgaacaaggctattcaacaaagggcaaaaaccggggattcggcctttatttcacacagcaaagcatcgaaaatttaaaaggccaaatgatcctcacaagcgaaaagaatgaaggaacgacattcagtattcgcatcccgtacgaaccgaaggaggaaaatcatgattaatgtactaatagttgaagatgaccccatggtgggtgaattaaataaacgatacttaagccaaatagatggctttcagctgaaaggcatcgcttcttcctttcaaagcgctctgcatattttaggcgagcatcatatcgacctcattttgcttgatatttatatgccgggaaaaaacgggctggaactgctgacggaattgagagcccaaaatgaagcggttgacgtgattgtcatctcagcggccagcgagcttgacgtgatcaagaaaacacttcggtacggagctgttgattatttaatcaaaccgtttgaatttgaacgattccaaacggctctgtctgattacagacgaaaacaaaaggtgtattcaacccatcgcaacatgagccaaaaagaactggacgccgagctttttcaaaagaaagaagcaacagaaaaagtgcagcttcctaaaggcctgacaaaaagcacgctgaagctgatctggtccagtatccagtcatttgaaaatgaatcttttacgacagaagacttggcaaagcacacagaaatctctcaagtatccatacgaaaatacttaaagtttcttgaagatatacaggttctgaatgtagaaatggcgtacggaacgatcggaagacctgtgtttcagtacaacgtcaacaacagtaaccttaacggaataaagcaatatctataagaaaaacgcactgcttgctttgagcagtgcgtttttcctgtcatatctcttgccaagatgcttgattctattgttgataagttatacaagaataacaaagggcctttcaacatttttaagcaaacaattctaaaaatagatactttttaaaaaaattatgcgaaattctatttatttcttattagttaaatgataaattatgattggtaagttgatcccgaaaaactaagtcataagtcttacttcagaaaacgatgtcacggttttccgcccggaacgccttccacatccttctcttccccgcctttcgaaggaaatactcacaccacgcttattcagggaagaatagaactgtctcagcgcattccatttgttattatcagaaaattttatcgattctaagaaattgttcaggacagcccatcacatgactggccggatcagctttgaaccaaatttttctggggggttatatcttgaataaacgaaaaatcggattggcgatgtcacttgtgatcgcagcaggcaccatattaggagcatgcggaaacagcgaaaaaagcagcggctcaggcgaaggcaaaaacaaattcagtgtggcgatggttactgacgtaggcggagtggatgacaaatccttcaaccaatcagcctgggaaggcatccaagcctttgggaaagagaatgggctgaaaaaaggcaaaaacggttacgactatcttcaatccaaatctgatgcagactatacaacgaacttaaataaattggcgcgtgagaattttgacttaatttacggcgtcggctacttaatggaggattcaatcagcgaaattgctgaccagcgcaaaaatacaaactttgcgattatagatgctgttgtcgataaagacaacgtcgcaagtattacgtttaaagagcaggaaggctcatttctcgtcggagtggccgcagccctatcaagcaaatcaggaaaaatcggctttgtaggcggcatggaatcagagttaatcaaaaaattcgaggtcggcttccgtgccggcgtgcaagcagttaaccctaaagccgttgtagaagtgaaatacgcagggggtttcgataaagccgatgtcggtaaagcaaccgccgaaagcatgtataaatcaggcgtagatgttatttatcactctgcgggcgccactggcacaggcgtctttactgaagcgaaaaacctgaagaaagaagatccaaaacgcgatgtctgggtcatcggtgtcgataaagaccaatacgcagaaggccaggtagaaggaacagatgataacgtcaccctcacttccatggtgaaaaaagtagatacagtcgttgaagatgtaacgaaaaaagcgagtgacggaaagttcccgggcggcgaaacacttacctacgggcttgatcaagacggagtcggcatttctccatctaaacaaaatctatcggatgatgtgatcaaagcggtcgataaatggaagaaaaaaatcatcgacggattggaagtcccggcaactgagaaagagctgaaaacctttaaagctgaataagaatcgcagggataaggaggtcgagcccttatcccttgtttttcttttattttgaaataaaggagcggtcaatcaatggaatatgtcattgaaatgctcaatatccgcaaggcgtttccaggtatcgtcgccaatgacaatatcaatcttcaagtcaaaaaaggcgaaatacacgcgttgctcggtgaaaacggagcggggaaatcaacattgatgaatgtccttttcgggctgtatcagccggagcggggtgaaattcgggtgcgcggcgagaaggtgcacatcaacagcccgaacaaagcgaatgaccttggaattggaatggtgcaccagcactttatgcttgttgacacctttacagttgctgaaaatattattctcgggaaggagccaaagaagtttggcagaattgaccggaagcgtgctggccaagaggtgcaggacatttccgatcgatacggcctgcagatccatcctgaagcaaaagcagctgacatatcagtcggtatgcagcagcgcgcagaaatattaaaaaccctctaccgcggtgccgacattctgatttttgatgaaccgacggctgttttgacgcctcatgaaattaaggaactgatgcaaattatgaagaacctggtcaaagaagggaagtccatcatcttaatcacccataagctgaaagagattatggagatttgtgaccgtgttacggttatccgtaaaggaaaaggcatcaaaacccttgatgtccgtgatacaaaccaagacgaactcgccagtctaatggtcggccgcgaggtatcgttcaaaaccgaaaagagagctgctcagccgggagcggaagtgcttgcgattgacggcataactgtaaaggatacccgcggaatagagacagtcagagatttgtctctttcagtcaaagcgggagaaatagtcggcatagcaggcgtcgacggaaacgggcaatctgagctgatcgaagcggtgacaggactccgcaaaacagattcaggaacaatcaccttaaacggaaaacagatccaaaacctgacgccaagaaaaatcactgaatctgggatcgggcatattcctcaggatcgccataaacacggtctcgtccttgattttccaatcggagagaatatcctgctgcaaagctattacaaaaagccgtattcagcattgggcgttttacataaaggcgaaatgtacaaaaaagcacgcagcctgatcactgagtacgatgtcagaacgccggatgaatatacacacgctcgggcattgtcaggcggaaaccagcaaaaagcgattatcgggcgggaaatagaccgaaatcctgatttattaattgccgcccagccgactcgcggccttgatgtcggagcgattgaatttgtccataaaaagctcattgagcagcgtgatgccgggaaagccgttcttctcctctcgtttgagcttgaagaaattatgaatctcagtgacagaatcgccgttatttttgaaggacgcattatcgccagcgttaatccgcaggacaccactgaacaggagcttggtctcttgatggcaggaagcacgcaaaaggaagcggggaaagcaaatggttaaacgactctctcatttactcgtgccgctcatcgcaatcatccttggtcttgcggccggcgcgttgattatgcttgtgagcggctacagtatggccagcggatattcggctttgtggaatgggatattcggagaaatctattatgtcggagaaacaatccggcaaattacgccttatattttatccggattggctgtcgcctttgcattccgaaccggactctttaatatcggcgtcgagggccagctgctcgtcggctggacagcagcggtttgggtcggtacggcgtttgatggaccggcatatattcacttgccgctcgcattgattacagcagcagctgcaggaggattatgggggtttattcccggcattttgaaagcgcgatttttcgttcatgaagtcattgtcaccattatgatgaattatatcgcgctgcacatgaccaattacatcatttcaaacgtcttgacagatcatcaggacaagacggggaaaattcacgaatccgcctccctccgctctccttttcttgaacagctcaccgattactcacggctgcatttgggaatcatcgttgcccttctcgcagcagttatcatgtggtttatcatcaacaaaactacaaagggatttgagctccgggcggtcgggtttaaccagcacgcttcccagtatgccggcatgagcgtgcggaagaatatcatgacctccatgcttatctccggcgcttttgcaggccttgccggagccatggagggcctagggacattcgaatacgcagcagtgaaaggcgcatttaccggcgtaggctttgacggtatcgctgtcgctcttctcgggggaaacacagccgtcggcgttgtactggcggcatgcctgcttggcgggctgaaaatcggtgcattaaatatgccgattgaatcaggcgttccatcagaggtcgttgatattgtgattgccattattattctgtttgtggcttcaagctatgcgattcgtttcgtcatgggcaaattgaagaaaaagggggcgaactaagtggacattgtgcagattttatctatcattgtccctgccacactcgtctatgcagccccgcttattttaactgctctcggcggcgtgttttccgagagatcaggtgtggtgaatatcggcttagaaggcctcatgattatcggggcgttcaccagcgtgttatttaatttattttttggtccggaattaggtgccgccgcaccttggctttcgctccttgccgccatggcagcaggcgccctgttttcactgattcacgcggcagcggcgatttcgtttcgcgccgaccagacagtcagcggtgtcgccattaacatgctggcgcttggggcaactttatttatcgtcaaactgatctacggcaaagcgcagacagacaaaattccagagcctttttataagacgaaaatccccggtttgggcgatattcccgtcttgggaaagatcttcttttcggatgtctattatacgtctattcttgcaatagcacttgcctttatttcctggtttatcttgttcaaaacgccgttcggccttcgtatccgttctgtcggagagcatccgatggcggccgatacgatgggaatcaacgtatataaaatgcgctacgtcggcgtgatgatcagcggattgttcggcggtctcggcggcggcgtatatgcctccacaattgcgcttgatttcacgcactctaccatctccgggcaaggctttatcgccctggcagcgcttgtattcggaaaatggcatccgaccggagcactgggggccgccctgtttttcggattcgcccaaagcttaagcatcattggatcgctgctccctctttttaaagacataccaaatgtgtatatgctgatggctccttatgtcttaacgattctcgctttaaccggctttatcgggcgggcagatgcgccaaaagccaatggcgtgccttatattaaaggaaaaagataaaacattctcccctgggaagacgattctcagggatttttttctaatccaaaagacccccttaatttaattgtttattagttttttaacttaaaaaaatatgaagtgttaacgctttcttgtagactgtaacaaacaatacatgggggtgtatgacatgggagcaattccaaaaacggggacaatttcacctgagcaaaaagactcacaggggaaaaacctgtttcaaaaaatctggtcttgggaaatcggtgtgattcctctgcctttatacacagtattagctgttattattattcttgcagcctattacaatgagctgccggcaaatatgcttggcgggtttgccatcattatgattcttggtgtgtttctcggagacataggccaacgcataccgatattgaaggatattggcggccctgctattttatctttgtttgttccttcatttttagtcttttacaatgtactgaattcaacatctttagacgctgtaaccaacttgatgaaaacgtctaacttcctttatttctatatcgcttgccttgttgtgggaagtatcctcggtatgaacagaattgttttaatacaggggtttatcagaatgttcgttccactggttgcaggaacgatcgcggccgttgcagccggcatccttgtcggatttatttttggctatagtgcctatgattcctttttctttgttgttgtcccgattattgccgggggaataggtgaagggattttgccgctttcaatcgcctattcacaaatactgggctcatccgccgatgtatttgtgtctcagctggtgccagccgcaattataggaaacgtttttgctatcatatgtgcagccttaatgaaaaagcttggcgataagcgtccagatctaaatgggaacggacgtctcgtaaaatctaaaaaagcaaatgagattttcaatcaaaaagaagccgaagcaaaaattgattttaagctaatgggagcgggagttctgctcgcgtgtacattctttatttttggcgggttattggagaaattcatcttcatcccgggcgcgatcttaatgattatttcagctgcggctgtcaagtatgcgaatattcttccgaaaaaaatggaagaaggcgcttaccagctttataagtttatttcttcaagctttacatggccgctgatggtcggtctcggcatcctctttattccgttggatgacgtagcgtctgtgatttctattccttttgtcatcatctgtatttcagttgttatcgcgatgattggttctggatattttgtaggcaagctgatgaacatgtatccggttgaatccgcaatcgttacctgctgccacagcggcctcggcggaacgggtgatgttgccattttatcggcatcaggaagaatgggccttatgccgtttgcccaaatttcaacccgtctcggcggtgcaggcacagttatttgcgcgacagtgctgcttcgttttttcacttcataaacagaaagagttccgttttatgcggaactctttttttatttattcacaatccgaatatactctcggggaccaaacggcagatcctttgattccgtctcactcattctggctgacaggtggtgctccagtaaatacagctcccactcatcactagcggccacaccgctgcgcccgtcatattgattcaacatgaatgcccctgcaaatactgagcagaataaacctgagcacatcacgacttttcttttcacatgaccagctcctttccttcagcttgatcaggattgattttaaatatacaaataacctcttttttgttagacttattttgaggtcaaaagaactcataaaaacccattacagcagttcgaagcgtggcagcttgcagaaaagtgcgatataatttggactaggtcgtttgaccgtatatttcatacatagcgcatttttcaattgagaacgagaaaaggaggtcttatctttgcagctcttacatcttgctattttatcgccttttttatttgcttttatcattcccttcttggcaaaatacgcaaaaagagtgcatacgggctggtttgtgttgatcctgcccgtcttgctgtttatatactttctcccaatgatcaggatgacacagtctggagaaacacttcgatcggtattagagtggattccgtcactcggcattaactttaccgtttatatagacggcctcgggttattattcgctttactgatcacaggcattggctctttggtcactctttacagcattttttatttatcgaaagaaaaagaacagcttgggcccttttatgtctacttattgatgttcatgggcgccatgctcggcgtcgttctagtagacaatgtcatggttctctacatgttctgggagcttacaagcctttcatcctttttgctgatcggctattggtataagcgggaaaagtcgcgctatggcgcagccaaatcacttttgattacggtcagcggcgggctgtgcatgctcggcggatttattctcctttatttgataacggattccttcagcattagagagatggttcatcaggttcaattaattgccggccacgaattgtttatcccggctatgattctcattttattaggggcttttacgaaatcagcgcaatttcctttttacatctggctccctgacgcgatggaagctccgacgcctgtcagcgcttatctccattcagctactatggtaaaagccggcatttatgtgattgcgagattcagtcctattttcgccttttcagctcagtggttttggatcgtgtccctcgttggcctctttacgatggtttggggttcattccatgccgtgaaacaaactgatttaaaatcgattttggcgttttcaaccgtcagccagctcggcatgatcatctccatgctcggagtcagtgctgcggcccttcattacggccatacagaatattatacagttgccgctatggctgccattttccatttaatcaaccacgcaacctttaaaggaagcttgtttatggcagtcgggattatcgatcacgaaacaggcacacgggatatccggaagctaggcggcctgatggcgattatgccgattacatttaccatttccttaatcgggacattttcaatggccggcttaccgccgtttaacggatttttgagtaaagaaatgtttttcacaagcatgcttcgcgtgacacattttgacctgttcaacgtgcagacatggggcgttctgttccctcttttcgcctggatcggaagtgtatttacgtttatctacagcatgaaattgctgtttaaaacattcagaggaaattaccagcctgagcagcttgaaaaaccggctcacgaggcgcctgtcggcatgctcgtaccaccggtcattcttgtcgctttggctgtcagtctcttctttttcccgaatatattgtcgtacagcctgatagagcctgcgatgaactcaatctatccgacactgcttgccggccatgagaaattccacgttcacatttcacagtggcatggggttacaacggaattgctcatgactgcgggtattgttgtgatcggaacaattggttatttgtcgctgaataagtggaaaggaatctataaactgtttccttcgaaactcacactcaaccggttatacgataagcttttgactctgatggagaaaggctcttaccgggtcacaaaacaatatatgaccgggtttttaagagattatttgctgtatatcttcgctggtttcatcattctgataggcggagcttttgccattaaaggcggattttcatttaaaacggaaggcatggctaaaatcggtgtatacgaaatcattttgacgcttgtcatgatcagcgccacagtggcgactgtttttgctaggtcaagactgacggcgatcattgcactcggtgttgtcggttatacgcttgcattgttttttgtcattttcagagcgccggacttggcattgactcagctcgtcattgaaacgatttctgtggcactgtttctgctttgcttctaccatttgccgaaactgagactgaaaacaaaaacgagaacgttccggatgacaaattttatcatttctttaggcgtcggtgttatcgttactctgctcggcatcgcatcctcaagccagcggacaaaagacagcattgcgtccttctttgtcaaacacagccacgatctcggcggaggggataatgtcgtcaatgtcattctcgttgatttcaggggatttgatacaatgtttgaaattacggtattaacgatagccgctctcggcatttacagcatgattaaaacaaaagtaaaagaggaggggaaaagcggtgaatgaacaaaaaacaaatgacttgattcttcaaactgcgacaaagcttgtatcctttatcattttgcttttctctttctatttatttttatcagggcataacgcgcccggaggaggctttgtcggcggactgatcacgtcctcttccatcgttctcttgctcttggcgtatgatttaaaaaccgtgcgttcccttttgccggtcaatttcatttatgtcgcgggagccggccttctgctcgctgtattaacaggcgttggctcctttgtcttcggggctccttttttaacccacacattcggatactttcagctgccgatccttgggaaaacggagctcgccacagcgacgatatttgatttaggcgtttatcttgttgtcgtaggcataacgatgaccattattcaaacgattggagaggaagaataatggaaatcttaatggctgtattagccggtattatttttatggctgctacgtatttgctgctgtctaaaagcctgcttcgcgtcattatcggaacagcactgttaagccatggcgttcatttaatgcttttgactatgggagggttaaagaaaggcgccgctccgattttgagcgagcatgccaaatcatttgtcgatccgcttccgcaagccctgattttgaccgcaattgtcatttcttttggcgttacatcattcatcctcgtcatggcctttcgcgcttatcaggaattgaaatcggacgatatggatcaaatgaggggaaatgatcaacatgaataattttgttattttgccaatcctgatcccgcttttgtcggctattcttctgattttcatgacgaagaatcttatgctcatgagaatcttcagcacggcggcatcggccatcgggattgtgattagcggcatacttgtacagactgtcttcacaaaaggtatccagacactcagcttaggcggctggaaagcgccgtacggcattgtgctcgccgcagaccaattcgccagcctgctcgttctcacaacagcggtcatcggtttattggttgggctttattccttccgttccgtcggtgaaaaacgggagcgctccttttactactccggcgttcagttcttgcttgccggtgtcagcggagcgtttttaacaggcgatttatttaatatgtacgtattttttgagcttctgcttattgcttcctatatgctgattgtattaggcggcacaaaaattcagctgcgggaatcccttaaatatattgtgtttaatatcgtatcgtctgccctgtttgtcataggggtcggctttttatacgctgtaaccggcacgttaaacatggcggatcttagcgtgaaaatcagcgaatcaggacaaaccgggctgatcactgtgattggtgtcctgctgcttttggtatttggcatgaagggcggaatcttccccctctacttttggcttccaggctcttattacgcgccaccggcagcaatctccgcgttgttcggcgctttgctgacaaaagtcgggttatatgcgattacgagggttttcacattgatttttattcacgatactgcctttacccatcagctgatgatttggctggcggcgctgactgtgattttcggtgtgatcggttcactcgcttattcgaatgtcatgaaaattgtgatctataacattattaccgctgtcggcgtgattttgttcggtgtggcagtacacacccccgcatccattcagggcgcgatctactatctgattcacgatatgctgattaagggtgctttgtttatgctggcaggtacgctgatcgcattgactggaaccgcgagcctgcataaaatgggcgggctgatcaaacgctatcctgttcttggatggatgtttttcatttccgctatttctcttgcaggcattccgccactgagcggatttgtcggcaaatttaaaattgcagagggcggcttcgcagaaggtgaatttacgatatccatgctgattctgctttcgagtctgcttgtactgtactctgtgctgaggatctttatacatgcgttttggggcgaagaaaaagaaacgccaaaaccaaatcatcgaacagctaaaggacttctttatcctgcagctatttttctcttgctgtctcttctcttcgggttgggtacagaatgggtgtcgccttacgttgatcaagcggccgagacgctgctgaatccggaaaaatatatcgaagctgttctgaaggagtagatcgcatggcatttcaaattttattaaatgtgtttctcgctttttgctggatgttcttgagcaacagtccaagcgccgcaggattcattacaggctatattctgggaatgctctctctctttttcttccggcgctttttcactcgccagttttatctatggaaattgatttctatcatcaagctctgtttcatttttataaaggaactgtaccttgccaatgtcagtgtgatgaaatcagtcttatctccaaaactgaatatcagaccgggcatttttgcttttaaaactgaactgacgaaggactgggaaatcaccctgctttctctgctcattacattaacgccgggaaccttggtgatggatatttcagatgacagaacaatactttatattcatgcaatggatatcgaggatgcggaaaaagcgatttttgacattcgggagtcatttgaaaaagccatacaggaggtgagccggtgatgtttacgctgatcctgcaaatcgcgctcggcattatggcagtgtctacctttttgtatgtcattcgtgtcattaaaggtccgactgtgcctgaccgggtcgtggctctggatgcaatcggcatcaatctgatcgcaatcacggcgcttgtctccattttgctgaaaacaagtgcgtttttggatattattttgttgctggggattttatcgtttatcggaacgatcgcattttccaagttcctggagaaaggagagattatcgaaaatgatcgaaaccgctaaggtcgttgtggctgtattcattttgctgggtgctcttatatgcctcattgcttcatttggcgtacttcgccttcccgatgtgtttacacgcgctcatgctgcttctaaaggctcaacattgggtgtcaatatgattctgctcggtgtcttcttctatttgtggtttgtgacgggggagctctccgctaaaatcctgcttgggattctctttatctttattacgtcgcctatcggcgggcacttgatctgccgtgctgcgtataactccggcgtcaagcttgatgagagaagcgtacaggatgactataacggaatcagaaactttgtgattaaacgaaaagaggattcttatttataaaaataagcagccggacaggcagagttccggctgtttttttatttcttgatgacagccagcgtgcatctggatatacagatcagcctctcttgctcgtcatatatgtgaatgtgatagacaatcgtcgttctgccgatatgaacgggctcggctatcgcctttaccgttccttcctttacagattttaaatggttggcgttaatctccaaaccgacacaagcctgtgttgaatgatcaatcaggttctgtgcacctgcgctcgccgctgtttccgccagggccactgaagcgcccccatgcaaatatccgaatggctgaactgtccgatgatccaccggcatgaccgcaacgcatcgttccgctgtgttttcaacaatctctataccaagcgcttcaagcaatgtgtgtttcgtatccatcatctacacccccaacatttaaagtacaccgtctgatttcgcaatcaaaaccgcttccgtccgtgaaccgacattcagcttattaaaaatcgatgtcaagctgtattcaatggaccgcttgcttaaatgaagggcatctgcgatttcttggtttgtaaatcccttttcaacttcttgaagaatcaggcattctctaggtgtgagcacatcttgttctttttgagaggaaggagccggctttgttttttgctgagtcatcagctgtttaaagtaagcaaaatcgactaaaatttctccgttgagtacgtggtatatgtattgggtgatcttttctttagattccgttttgctgatggcaccgtgcagacccgcacgaatcgcttcctcgaaataatcctcgacctcataaccggtatacacgataattttacaatgaggattctcttgtaaaatctgtttagaaagctccatcccattgacctcgccgcctaaattcagatccattaaaatgagatcatatgacgagaaatcatgctgcttgataaactgttcgctcggttcaggactgagacaatcaacagacaaattcgaatccgtttccaaaattgtcttggtgccttccatgacagccggatggtcatcaatcactagtatctttttcatgttttcctcccttgtactcactcttttccattttataaaaaagacttggcctgtgccaagtcgtttccgttataaatccattacaattcgatttcaatatcagccttaaagccctttccttcacttgtttcaatccgtaggcgcccatctaaagccctgactctctccttaatgccagaaagccccatgctcatggaatgctcagtattcttttcctgatcaaacccaacgccatcgtcctcataatgaagaacgattttgttttgaatactaatgagcataatcagcacatccgtcgcctgagagtgcttaaccgcattagacagaaactcttgaatgatccggtataaattcagctgcgaatccagatcaagggaagccgtaaatctgccggtatttaaacggatatgaaacggaacccgctcctgctgctgcgccaccagcttcgacaacgccttcaccaatccaagatcatacagaagctgcggccgcagctcatgacacgtctccctcgtcatcgaaatcacatcagacatctgctcattcatctgtacaagcttgtcctgcacctcttcacggcacggattatcacccttcttaaaatcacccaaaaacagctcacactggcgttttaaggaaatcaaatcctgaagaaccgaatcgtggagatcgcgggcgagatcggagcgttgtttttcctcgatcgtgtacatgagttttttgagccatacggggttggattcttgttgttttatttcttctaaatgactcatcagttcttcgattttcatgacgttttcgatcgatacgtttgtataaaaagccaaagttttcagccaagaaagttcttcgagtgtgagacgaggcgtattcattttagataaacaaaggatcacaaatgatttaccaccgcgttcaccaatcttcatgacaaaacctttattaaattcaacgattttccctatctcggatgttacttttctaaattctttttcatagactttttcaaatgaatttacgttctcagcatcatatagtttaatatttccgtcagctgaaacttcatatacatgtgctcggctaacaagagaaacctcaagtatagtatttttcagttcttcaaatacttgagacagggaagtagagtctcttatcatctgcgtgaatttatatatactgtcttgataattgaatttttccgagaccctttttaatctaaatctgaaatcaagtacttctttataataaaagaccgccaacatgataatataaattaaaaaggttagtttaacactataaaaatcactatcaggactactaatcaattcaattgtagagattagaataattgttggcgttagagctaaaaagccatagtaccttaatctgcttaaaataaaatctacattatagattttatttgtcatgaattgaaatactaaggagaaaggtattagcatcataaatgaagctgctaaaaaggatgaaacatagtgcgcatttaaaaagacatacggtatcaaatataaacacaaaaaaggtgagaaagaaaagatattaataatagtgagaaccttaataatatgcgcttgttcagtatctttatttttaattaaaatgatacagaaatatatccctactatgataaataaaaagaaaaaggatagtaaacttaatttaggcacataatcacgaaagaaaaggtgtgaacggaacatttcacacactacatttatgatcggtaccaaatataaaatgaaaacttttttatcaaataaggtagtgcctaactctctaaaataatgataaagaaagagaaggtagtttagcggtacagatattaatgttaccaccataatacatctgcatagtatatcgcctttaacagaaactcctgcacttatataagcaatagaagcggataacagaaatataattaaaactaaagcagatggtaaatcctttgattcatttatttttattataaataggcaacaaaataaacaaacaatataaaacattaacggtattaagtaagtagaaaaatttttatcattaaataaagtcagctttagctcaacatccttgccatttctctcaacaaccattgagctcacatttttaagcttattcatttttatttctttagtgtttatcttttgattattaatacgctttacgatatcccctttttctattccactgtatgatgccattgaatattcatctacattggtaattacaacgtctccgttcttccctttcgaaacagttgctccaactaacaaattattattgcttatataggtcaaataaataacatataacagacttattacaactaacaatacagaaattttattggttctagacttcatttaaccctcaatagtgccaatccatcattgaataaatttctaaccctttaaaaccatttatgatacattcagattgatctttatcaacacccaataaacaagcattcccttccattacttcccttaaaacatttgggtatttaattaagtatcctaccatttcttgcataataaatcccctccttatttaatcataacagacaataatttttcagttttatcttcttctagttttaattgtgacatttcattctttattttttggagagataaatgtttcatcaccagtaaatattgtataacgcctgcttctgtcaattttcgcttcaaagccttagtattaatagaaacaaattcctctggtttttgatataaacttagtagctccgctgaagcatcgttaaattgtttctttaagtataagtatgccaatgtattttttttctgaacaaaatcgttatttaagtaaaacaaacctttataatcattatcgatctgtgaaataatcccaagttcataagaatatgaagctacaatgggatggtatttgcctgttgccagcattactcccattacacagggcaatgccgttagcgctcctgatttatttttgatcatttcaagacaggcttcttccgtttgcggtgcattcacaatatcatcatgctggccttgaattgattgtaacgcaaaattcaatatctcttgtgaaaattctggttcatgactagcttgacacatcacttgtatacttagggtgtaaagagctgtaactgcatttaaagcgattgacgagtcaatcttcatccagacagcacttccattatcttgatcctctaagtcatcataaatatcgaatgagagtataagcaattcaattccggcagctagcaattcgattgctttttggtcctgaccgttaaaagctaaataatgatgaagagccaaatcggcaaactcaaacgtatccttagactcaataaaattctgaagatatcgttccaagtcctgattcattattttttggcttacaatctccttcattttctccttgatccggacagaatctaaacatatctgctcaataacgacttcccccctcccattccattttactaaatgggacatttaaaggacagcaggtttttcgttttttaacaatcatataatactttatccatttattgtatcggtagaacgaaaaaaagacttgtttccaagtctttttcacgaaattttcattgcataattgtatttatcgagttgatcaatgcttttgttaatgtttcgtaatgaatctgtcgtttctttaatatcaagttcgagtcggaataacaattgttttacttcttcaagtttcttttccatcgtttccacactcctttttttgaaagatcaatgaattgtgtatggtgaacgagtcctaggtatttgatctgttactaatagtgtatctgctttcggctcatttttcaccgaaaagtatgcaaaaagatcctgcgtgacaccgcaaatatcaataggtccttatactcaaaggaatcacaacaagaacgggactatctttctatgcgaaagagcgtttatatgtgctcaaattgagaaagattcttaattcccttgattttaacgtgtttcgcatttttactaagtaagactatagtccttcataccgtattttcaaaattgaatatgcgattcttggcgtttcctgaccgacaaacaccgaaaaagaccgcaacgctaaagttgtggccttttcgctttgtcatattcggcaattagggatctatacatatagaaacatccttttttttgtgaggtgctcccatgagatatcgttatccctggttttacgtgtatccgtatgaggtacgccgtccgcccgttcctgccaacaatattgatacctttatccgttcagcgaagcaggccgcagggatatttgcggatgcccagctcgttctcggccgcattgcgggctcgcgggagctctcgcgccgcattctgaccgcagccgagcagtccgataaacaaaccatcaagcgcctgatcaaacaaatgggcgtccggcatgaagtggatacggtctttaatcccgacggcatctatatcagtcttatcggaacgcaaagccgaatgattcttgctttgcggtggtcagaggaccgcaatcattttgcgtccataagattatgacaccattccagagcctcaagataacattcatacgcttcttctttgtcgagttgattgcctaattccgagcaagtgtcccagttgttgctttcaattaatttcacaagctcaagcatttggtagtagtcgttttgatggcctaataatgcttgcccgacttcatcttttaaaggcaattcttgaacaatttcctctatttctctatgcaggagggtgtctatgagagaaaacattccgatcagcatataagaagcaggctgcggccgggatgtctttctcgccagcagttcgcaaagctttgctcttatcaaagaaatcttaatgatttcgtgcttgctggaatgccctttcctgcttaaatccttaaaggaaagaatatatatccaccgtttgatttcattaaatcccaacagcataatggcctgttgaatgctttcaattttctggctcaaacggctgtgggatgagtttaaaaattttaaaatctgataggacagtgataaatcccgctctatgtactctgtcacacgctttatgttaggctgctctttactcagttcgttaagcagttcatagtaagaatagaaatgagtcgataggtcatgcccgctgatgatgcgcggctcgctgaaaaagtagccttggaataattgaaagccgtcttggaccgcctgtttatattcttttcgggtctctactttttccgctaaaaaaatcaggccgcggcagccgtaggtttgcaaaattgttctgcgttccattcgtgttgttttgagaaaatcaattttcaatatatcaatatagctcatgagtttttccagtaagtcctcatcttgcgggtttattgcataaaaatcatcaagcgccagcatataccccatttttttcaattctttgcatctagaaatgagggccggcgtgatcggtatatcttcaaggatttcaatgacaagctgtttcggattgaaggaggtgggaagattcgaaaacatcaggctttccgtaaaattaacaaaacagcgtttcccttccgtcagcttctcaattccgatgtttaaaaagctgttgatcaccaaatctgttgttgcctgatcgccgtctttagcgctatacacgttctcttcgctttctctatacagcagttcataagcaacaacctgttcttttctattaaaaataggctgtcttgcaacaaacaccctcattgatttatcccccttacaatacgcgcggctttcacccctaagtatatcaaataatttgacgaaaattgtctaaacatgaaaaataatatatacataaagaaaactggcccctcgcgaacgaaaggccagtttttctttattcttcctcaagctcttcttcaattctgcttttcacttcgtggatccgctgcattttattgctccagcagtcctcgcttaaatcaaccgggtattcctccggcttgctgattctcttatattcctcccaaagcaggctgaggttatcctgcacatactgctgtatgtctgaaatctcagggttttggtagcaaagaatacccttctcaaaaatcagctcatgaagatccttcgcataaaaattcgtgacaaatttgctgatgaatgtatgaaccgggtggaacattctgagccgcttctgatcattcacctgctcatcataaagcgcaatatagtcgccttcagaatgatggttggactgattaataatgcggtagactttctttctgcccggtgtcgtcactttttcaggattggacgaaattttgatcgtgtcaaccattttcccatcttcttcaatggcaacgagtttataaactgcgccgagagccggctggtcataggcagtgatcagcttcgtaccgacaccccagacatcaatgcgcgctccctgagcctttaaattcataatggtgtgctcatccaaatcgcttgaagcaatcaccttcgcatctgtaaatcctgcttcatcaagcattttccgggctttttttgacaggtacgccaaatcgccgctgtccagacggatgccaatgaaattaatgcggtcgccgaattccttggcaaccctaatcgcgttcggcatgcctgaacgaagcgtgtcatacgtgtcaactaagaaaacgcaatccttatgtgtttccgcgtattttttgaaagctgtatattcatcgcggtaagcctgcacaagcgcatgcgcatgtgtgccggaaaccgggatattaaagcgctttccggctcttacattgcttgtcgcgctaaagccgccgattaaggctgctcttgctccccacatggccgcatccatttcgtgcgcccgtcttgttccgaattcaagcgcaacttcatcaccaatgacgcctttaatccgggcagcctttgttgcgattaatgtttgatagttcacaatgttgagcaaagctgtttcaatcagctgcgcttctaccaggggtgcctccaccctcataatcggctcattgttaaaaacgagctctccttctttcatggagtaaagtgaacctgtaaaagataagccgcgcaaatattcaataaaatcttcatgatacccgagttcatcctgtaaataactcaaatcgctatccgtaaacttgaaattttccaagtattcaatggctttttccaagcccgcaaatacggcatagccattttcaaacggaagccttctgaaaaacagctcaaaaatcgctttcttttcatgaatgccgtctctccagtacgtttccgccatattgatctgataaaggtctgtatgtaatgacaggctgtcatctttaaatccgtactctaacactgtttttccccttccttactctgccacttgcgctccgatgctgtttgcaaaatgggaaagagcccatgcgtgcccctcctgattaaagctggctacagcttgtttatgcacaacaatccgaaaacctttgttatatgcgtcaacagctgtatgcaacacacaaatatctgtgcagacaccggcaaggtgcagttcgccaatctgccgctctctgagtttgagctctaaatcagttcccgcaaaagcagaatatctcgttttttccatgtagtaaacattaggctcatgttcatgtttctgatatagagacaaaagctttccgtacagatcttttccttccgtgccttttatattatgcggaggaaaaagacgggtttcagggtgatattgatccccttcatcatgagaatctactgctaatacgacgtaatcaccgtttgtgatgaattcttcagttaaattgacgatcgcctcttcaatcattctgccgggctccccgcaggtcaattttccgtcactcgccacaaaatcattcgtataatcaatacaaataagtgcttttttcatagccggcctccccgccatcagtatgagaacattatatcttatctccagttgtaagtgaattgccatgaacaaaaagacaaacggtccgtttgtctcttaagatttcagcactgaccgattataaatgtcgtcctgaatatatatcaattcacgattcacagcgatgtcagccgcaataacgaggcctaaaggcgtatgaaactgaagatcagatacaatcttgaagggcactccgtaccggttcgccatttggatataaggagagtaagactgatactgaagctctccattaaccaaaagggtgacgtcatggctgtttttcagctcgtgctccgcctctttatacggtttacttctaagcacctgtcctttcgtcagtgccaaaacgactctttctcttaaagagcctaaaaacaaatggcgctcgtcaggctttgtctccaaaggcccatacattccttgctgcaaatagagatccattttatcttcactcaaaagcctgtcctcccgtcttgtttgtcttcattatcacctgatcaggcaggagctaaactttcaagcgccgcttacatttctgttacccaatgaatgatttttttggccagctcaccagcaggggtttcctctgtatgccggcgcaacgacgcttccagccgttcaggcagagttgctttatcttcttcataggaaatgatcgtgctccactccagctgcggtaccgctacaagcgtgcgcagttcttttctgttttcatgcagatacacgtccatgatcattccggtttgcgtattgatatttgcttttctgattttcataacatgacctctctatttaaagactacccatattatacaataaaaaagcaacagcctcttgtgaaaaggctgttacccgttaaacgaaactgtttcatcagtgatatcggcatctttgaagagagttttactcgtttggttgttaatcttcacaaaatcaccaagctgaaatgtgcctgaccccgcccctgaatgagcgacgcttttgggcgaaatcgcaaatacgtctccaaagcttgccgcggcattacccgtaactgacatgatataaatcggccccacaattgcaggcatttccccacctccgcattgatttacagcatcatatgcaaggagccgataatggtgcccgcctattcagctggctttgcgttttcctcgagtcgtgaccgctggcgcagcttgatcaagcggacaatattcaggaagaacgccttcactaccgcataaaccggcaccgctaaaatcatgccgagaattccgccgaagcttcccgctccgattaatagcaaaataatcgtaagcggatgggtattcagccgctttccgatcacaagaggagacagcaggtttccgtccagctgctgaacgatgacgaccacaataatcgcaaacagcgctttggccggcgagtccataaaaccgacaatgacagccggcgcggcaccgagaaaaggcccgacatagggaatgatattggtaatcgccatgacaatcccaagaatcagggcatacggcagtccggcaattaaatagccgataaaacacgctgttccgacaaaaagacagattaacagctgcccctggaaatatgccgcaagcgtatcggataaatctttaaaaatctttaagccttctgtccgataagaagccggtagaatttttactgccaaatgcggaaagcggtgtccgtctttcagcatgtaaaaaaggataaatggaacagtaataataacaagcgtgatgtttgtcacgacaccaaacaccgcagataaactggacgtgatattttgcggcaggttttggagaaaacttgtcaatgactgttcaatttttgatatcgatacataatcctggttcatcatccaggtaaaccattgagaatgggacaaatcctttgtcagcgcctgaatctgttttatataatcaggaaggttgttaaacagccctgtcacctgtgaggtgatgataggtccgactgacgctgaaataaaggcaagcaaaccgataaacagtaaatagatcaatagaatcgataatgtccgcggaatttttttctcaagcaggcggacgaccggattaaatatgaaatacaaaattcccgcaatcagcatcgggaaaaacaatgtcgagataaaaacaataaacggctgaaatacaaatgaaacttttgttgctacaaaaataatcagcaaaacaaataaaatctgcaatgtccaaaaatggacttttgatttcaacaagctttgttcctcctagtttttctttgtctgtcagataaaagaacttataccccatcattgtaacaaaaatgaactcatatcagaactcttaatataatgaaaggagtgttggtgatgaaggccgtgacatacgatacagattcagaactggcttatatctatgttcttcctccgaaaaagaacaggaatgtacggactgaggagctcagagtcaatgattgtctcctgctggatatcagccatgacggcaaaatcgccggattcgaatgttttggtgaggcagcacacctctgtgccccatttgccgggaaatcccggctgtatgtaaaagattcagacggttatcattttcgggtctgccagcatgcttcagtccgttcctgctatacggtgtacggtgtcactttctgtttttcagatggtgactatcaggaatttgccggctttgaccttgatggaacaatgtatcttagtgcgtttttacagcgcttaactgaaaaataggacgtcccggtgtacgcctatttttcatgcgcaagcactgttagacccgctcactgtaatctggggtgacggaaatcatgtgctggattctgatcaaacaaacagaatttcgggctccttcaattgtgatatggtcaggttttacatcgatcagtctgcctctgaccgtatctcgtactgtctgtataacgaacctcgagccgatgagctttttaatagtctgatagacataaggatcgactaaagagaccagttgcggactaccttggttgaccatacttttatcccctttgtgtgttttatctcagcttatgccgcgcttatggataatgacacaggcttacctgataaaacaaaggggtgcggagattttaggagaatacgtttggaagcgggtgtaaaggaagtatcgatgaagcggagacagcgaagaaagctgggcgctgttccgtacttatacaggctttatcacggatgcctgggcttggtcgattaattggtccagcttttctattttttttcgtgcggttgaaggatcaatttggcggtaatgatggtggccgcccggctcttcatccagttcgtccgcttttttgacaatctgctgcagcgtgtttttatctaattcgccttcaggcaaataggaatctgtatgaagcaaaatggctagtgcaatctcttttgccgctttcggttcctcgccaagccgaatcagaagcttatgcgcccgttccgcccctttaatggcatgaatgtcatttcttttgtatttctcataatcccactttccgtctgtataccattcataatggccaatgtcatgaagcagtgccgcttttgctgctaaatcaggattaatgtcagccttcacagacagcctgtatgcatgataagcgcaggcaatcgcatgtgccacgccggaacgctgaagatatttttgtgcaattggatgggtgaaaacatccattaatgtaacctttctcatggaaacccctcctttagatatttttagaatcctaacataatttgcagagaaactcaattcttatgtcacatcattttgatcttcttatcatcattgttataccctaaaagcaacgtttcagtcagtatatgcggctgttcaataaaatgcgctggctgtagccttttgtataaaaaaaagagcagaaaatatctgctctacaaaaactctttaatatcataaatgcggccgttttccgtccctttttctagtaaagaaagcagcgtgccggcaataaagtccggactgcgaaggcttcctgtttcatttaatttccggaatcgttcaatgtggtggaaatcctttttcgatgaagaacggatgacggcctgcatctcagtgtccatcactccaggtgagaacgaaatcatgctcaccggcagctcttcatcctcctgttcaaatccgaatgtcctcgtaaacatgtcgagcccggcttttgaactgcaatacgcgctccatcccttatatggatttttggcggctcctgaagtaatgttgacaaccgtctttttgccgctgtatgaagcaaaccgttttgtaaacagctgactcaaaagcacgggcgcagtcaggttcagctgataatggcgctgaagctcgtcaagagacgcttcgccggcacgtttgatcggcgttaccattccggcgttattaataagggtaataccagaataacgatctgaatcgatggatgagagcaatgtttcaaattgctgttcagcttcttcgagattgatgaggtctatttgatgctgcgttagttttttgtgagagacatccgttttcgttctggataaggcatggacttcatgccccttttctaaagcctgtaatgcaatggcttgacccagcccttttgacgctccggtgatgatataaagttccattggaaacctccttttccgttattattgtacggcaccgcttttacacaacacaagcacgcggcctacgccttcttgttttcctgcgctgtgacttttgggatgaggaacacgatgcctgcaattccgaacaggatcagtacgacatagatcatcggcagcagcaatgatgatgtttcttgttcatcttctgtttccgttgatgatgtctttgttattggtttttctgcaaatgtaattccaagctgtttcgactgggccgcaatcgtgttggaatcctcggcatttgttgatgtaaacaaatcttttatcagctcggcgtccttgtccttcggtttatcaaaagtgatatccttttgttcctcaggcagttctgttttttcttcatagtaggtatcttcatgcaaataattcgtatcgatttcgatgtcttttttctcatactggtttggcgcgacatctgtattttcttcagtttgggcagccgctgcagagggtatgaaaagggaaaaggagagcatacaaatcatgatccccttttccatgctgcgatcacgcttcatacgtttcatcgctttctgctgtgtgttcagccatcagccggataatcagcggcagagccgcggcaatcaccgtaatgatcagcagaactgttattcccattgtaaacaagtgcccagtaccgtactggatgtcgatatatactttcgaaaccggatcttcaaatgtaaagttcggcatgatcaaatcaataagcggtgcgacatagaatagaatcattgccgctgaagcaacccagccagggattgatccgaatctgaatgccgtccggatgaaggcagagcttgcgaccagcaatagaatcgtaaacaccgaccacttaatcgtctgatcgtccggcaatgaataaatattcaagccgaacaagctgatcataagtccgacaaggatattcagaattccgaataacgctcctttgacgagaagcggtgcgttttggtaatacgagctgaaatagccgattaacagactgctgatcaacacaatgacaaggatgacaaccggaggtaccgtctgaattttttcttccggaacctctccgctgattttaagcggattcgctaagtaatcatatacatagccattgttttgcccgtctactaatgtatttccgagtatgccgtatacgtcatttcgcacgagtttcgtggaggctacatttttcccccagttgttgtttaaggtgtcggctttcgcttgaacatcattgacgctttgctgcatgttggttgtgtaatcaatgatgcctgactggcgatcagacaatgaacccatcatgtctgacatttgcagcacttcctggccgaccgtatcttggacactcagtgccatggtgccagacagcccatcgttgctgaacgtcgcagattcctgtgttgcgcccgttacaagctgttctgacgcttttgcggcactttcagagattttcgtcagttcgtcgagaacacctgcttgagagtcacggataaagccgctgtagtcgtccgcaaatttggtcatgccgtcgatgaagctgttaatatcctcatctgtttgcatcgtgttgtttttgagagcttcccagctggctgattcttccggcttgatggctaggactgatttgacgttgctatcttgttcttggatgacttctccgcttaagatagacatagaaccgatatcgagggagtcattaagcgctgcctcgtacaaatataaataattgtagtatctcattaaattagaaatattctctgtactgattttgcttgcaaagaaaggctttaatttttctcctcggcctgaatcccctttattcagtaaggtttgtattatcctttcttccattttatatatcagactataagaggcatcaagttccctattgagatcattcaacttccttgacaagtttttaatttggttatttaaatctttaactgtaccctctagttctttaatttcctcatttagctctttaatacgtttgtcaagcttagtgttatgatcctgttctttctcttgaagttgcttctcaatattctggattttttcggcagcttcattcagacgtttcttggcttttgaaatatctgtttcattttcatcatcagcatcgtgtgatccatcattttcatttgaactgtcgttttcatcagcgagttgaatcagacggagagcagttttagatgctgatgtggtttccgcatttgcaccttgatcattagtttccactgaaggaacttgctgattttggtctgttttttcattggtttgatcatcatcttgggacccattatctgaagagccactatcttgactttcatctgatgatccattttctccgttttcgggctggtcgtcagttgttggattctcagcactaggattttcaccatttgttggttcttcgcctcccggcgttgttgggtctacgtgttcaggctcttttaatccttcagagatgtctttgatttcaactgcaacatctttaagttcgtcacgttgctgttctaaatccagctctatatcttcagttgtgacttctttctccttatcccgatcatctgtttcatctgaattgtctacattagactcatcctgtgtgttatcgggttgtaaagtaggacgcagctgcacaatattgtattgcaattgatttaaattttcgtttttaactgcttcatattgatttttatatcgtgccagaaaagttttgaacatgtcattttcaatttttttcatgcccatttcctgaagtggaacttgaccttcccttgttttctcggtgttctccaaggctagacttgtcagattaaactgtgtcttcgcttggccgatcccggttgccaatccgctcatgcgttcgctgaactgattcgccttttgctgtgcctggatggaatccagacctgtccggatttgctgctgtgttgaatcctgggctgccaaaagcagctttttctgattctcttgatattctttgtacctttcaactgtatcaatgaattctttcagcgtgtttttggcttcctccgccgtagaagctttttcttttgtcgtgccttgcgcttcattcattgatttcttcagctcatcgattaagtctttttgctgtttgatttcacctgctaaatcattagagcttggtttgtaaaagttgtacatgacattctggaattcagattctttattgacgatcttgtcaaattctcctctgatgttgtccactttttgcgaaacaaagttccagtataaggccgacatttttttgttcattgtcttttgggcatcctcaagctcccgctgaactttttctttgttaaccgcattcaggttatcttgaatgctgaattcgagcgttgctttttgaggatggtctttgtcatagctcaaaatgttttttgagaagtctgagggaatgtagacaatcgcatcgtatttctttgaagcgagaccggtctcggccgcgcttcggtttacgaccgtccacgagtaatcaggacgttcacccagaacggccgctacttccttgccgaactgggcggatttgtcctcttcatcagactttacctcatcactcaatacgcctgtgtcttcattcaccaccgcgatttgccgggtggaattgactgcttttttcgttgggtcgtctccgataaatcggaaaaacaacaccggcagcagcaaaatgatgatgacggcggatattaacttgatcaagctttttcgttgttctgtcatctagcactctccctttcagcagaacataaaggaatttgaactttttgctccttcccgttttccacaacatatccgaagcccggctgaatctccggctcctgtctttggtacgggagaggaatgacattttgctcagactttttcatcagcagaatcgcgtggcggatttgcttcatctcagtcgtcaaggagtcatagccttttgagaattcgctgtggttaccacccgggataaaactgaagccaagatgagcgtatgatttcatgaagttagcgagacggtcttgtattctcgtatcaatcgtctgctggaatctcgttatcccgtcaatcatcagcaccacttgtgagaatcgaagattttgcgcgtctccttggcggacggcttctacatacatggcttctcttgttttgaaaatgtcttctgctgtttcaatccactgctcaatatcttctttcgtttccaaatatgaaacatctgattccttcgcataatgagataagccgcgatcaatcgagtcaaacaggccgatcatttcggtttcatcatcaatcagatgttcgagcatgacttttaggacgtttgttttcccgcgctgagtctggcctaaaatcaggcagtgcttatgcttgcccaaatcaaaatagactgggctgactgtttcttcatgaagtccgatcggtacagataaaggcttgcgttccagcttgaagcggagagacaattctctcgtagacaagctctcaggcagcatcggaatcggtgccggctgctccattgaagcaaatcgcccttgaagtttctgtacgtctgatttcagctcgttgaacatgccgatatcatcatcggcgtcaacaggcaggaacatttgcgcgaaataaagctcttccttttgaatgatgacgcgtcccgggatcggctcaagattgaacttcggacggccataaatggaatatccctcagattgatccatgagataatggacaacctttgttttcaagttatttaacaatgactggcggacagcatttacccgcgttgctgtcagcataaagtagatacccaagctttgtccgtctctggaaagctggacaaattccgattcaagctcatgcatctcatccttgacaatgtcaaagttgtcaatggtgataaaaatgaacgggagctcttcttcgctcagcgcattgtacattttgatgtggctgatttctttttcccggaacaaacgtttacggcggtcaatttcttctttgatgcgaatcatgaacttttcaatttttcttgactggtccatcaggaagtaatccgcggtatgcgggagcttcgctaatggcagcagcgttccgtttccgaaatcaaagatatagacatgaagctcttcaggtgtgtatacgtccgcaaaactcatcaggaacgttgcggctgcaatcgattttccgtagcccgaagagccgaagatgccgatatttccatcttccatcatcttataagcaattggcgcctgtctttgcagatcaggttcatcgacatacgcaaagtggaaatggtctttttcgtttgaagggaaaagagtgcgcggaatacgttccgcaagcggcggcagccaagggcttggcagcttctcgattcccatttcatcttggatgcgttcaatttcgtcaactacagcttcgatttcggtttgaacgtcttttttcgcgttatcttcggtatcaacctcagaaagcgggatcagacccgtatctgtgacgatcgcgatttcatcctcagtaccgtagacttcctctaagtaaggcgccccgctccatgcagattggaacagctcatacacttcattgtttccgacctgcaaatagccgcggcctgttacggtaatgtttgcggcatcgctgtttttcaaaatttctttactgtcggtggcatcctggaccttgagcgctactttaaagcgcgagttactccagatctggtcgtcgatgatgccgcctggcttctgtgtcgccaaaatcaaatgaacgccgaggcttcgtccgatacgcgcggcactgacaagctccctgataaaatcaggctcctcgcttttcagctcggcaaactcatcagaaattaagaacaagtgaggcatcgccacttctgctttcccttgcttgtatagctttgtatagtcattgatgtgattgacttgatactggtcaaacaggcgctgcctttttttcagctcgcttttaatggaagcaagcgcacgcatactgaagtttttgcttccttcaatatttgtgatcgtgccgaggaggtggggaatgttgcggaacggctgcgccattcctccgcctttatagtcaattagtaagaaagccgcttcatgcggatgaaaatgcactgcaagtgacaagatgtaggtctggagaaattcacttttccctgatcccgttgtccccgcaagcaagccgtgcggaccgtgtgctttttcgtgaaggttcagatacacaatgtcatctttccctttatagccgatcggcactgacagcgacttcgacgattcacttgtcagccatctttgctgaatgccgatttcttttacttccttcgcatgaaaaagctccaggaacgataccgtttccggaatggaattcgtaatgccgacctggtggttcagcgtccgcagcgtgcgtgagaaccgttcgttgtcctcacgctgatgatgatcgagacggaacggaattcttaccgcttttttcttttgtattaaaatgtcgccttcatgctcattaatgtagcggacaagagttgtaatgttttccgacaagctttcctttgtttccgccgcgacaattgtcgagatgcccagatgctcatgctgtccttctaaatattcgagaatgacatgctcagagatcagctgctgattcgtgatgacaaatacaaaatgcggtttgaactgcagtttttctttgtcatcttcgagatcacgctctctgatcaattcgtaaagtgaagacaagagctgatctcgggtttgctcattataaataaatccttttgcataaatatggggcatttgaaattgcggaagccacttcatccactcccagtctttatactcttcttcatgaaaaataaatacaaaacgcaaatcgtgatagctgttaaagaacgacagctgtccgatcaactggtgaatctcatttttcacaatttgcgatttaccgacaagccccatcggaccttctgccaaatcgaccgtcaccggcgcattgcggatatctttatagacgcgctgcatgtgctgcgatttctccatgaggtcatcgatatcacgattcgccaagtctccgccgctcatattgatttcataacttgacggaactgttcccgtcccaagccgcagctggagataatccttgctttcaagtgatttttcccagatccggtcactgatttcacttgttaagtatttcatttgttcaaatgagggaaagtgaaattcaagaacctgcttttgcttttcagcaagtgcctgaagctctttccgcttattgtctaagtaaagcttatatacacgctcccgtttttcctcgcgttttttccgctggtttttatcccggaaatattgcactgtcgaggtaatgagagtcatcataaacatggccaaagaaacgagtataaatatgccgcgcggctggatgatggcaactacgcccatcacgatcagcatcacaagcggaggcaggatgacgagccacagccctctgttggtttgatcgctctcctgagagggaaaactgaaagaaacgcggtcatccggcagatcgtataccatccgcggcgttcttctgtactgcggatattttttctgcatttctgtactcggtttgaccgtttctgttaacgctgtttcaaactgggcataatgaacaatttctaaaaggtcttgttccgtcaccctcatttgcgtgaagttccagaatatttcatcccccggcttgagcggcgtattggcgttgattttctctccgttcaagaagatcgttccgctttcagggcggaccgaccagctgccgcctgcacgaagcaaagaaaacgtgctttgttctgcaaatgcaaaatcttgctgattcagataaatatctgcattcgttttttctgaggaacatacaatttcatcccgatttcccgtaaaataaacggatttctcaggttcactgcccgtcaatatcaagcgtatatcctgctgatccgtttggagagtaaatgatatatccgtctcaatcgtgccgagacaatcatttcccaggaaaacttcgtattggccgccggattcctttcttttaagagaaaccactccgctattaaatggaatggagctgatcgtaacagaatccttcacatcaggccctatggtcaccggatgagacgacgggaggttagacagatttaatttttgaacgttattttggtaaaaaacccataatagactcaaatggcgaacccccttacggccgaatggcagcatgcgatgacctgtgcttcatgtctcacgttatttgtcatcttttttctcatctttcttttctgtttcttttttctcgtcttcttttttcttctgttcttcttttttcgctttttcctcggctgtggctttttcttccgccactttctcttctgcttgtttttcttcgtctgtttgtgtctgttcttcgcttgtatcgactaacgatgtttcagaattagactgtttattttcttgacgttctttttgcgctttttcaagctcactatttactgaatcaagttctttttgtatatcttcatcatttgtatcctcagataaaagctgctgtttatatttagctagggcaaagtaaatataatcattgtattccagcttgcggccgatactgatcgcttctttgtattctcctcgaccataatcaatccaatataagaaatgctgagggtctgattgaagggtgactaaattattttctatatttttggtttttgcactccccaggttttcgacctcaacataggacgtcgccagctgatactgcaccgattcaggcaggctttccgcatcgtacttggacagtgtgctgatgacttcactgtactgcttgtttaagaacgcacgattgctgtccactatcacttggtgctttggctgcgcgaaaaataaggcgtacatcgaataaataagtgccggtacaagcaaaacaatgagccccaggccgatatatcgctggatgttccacttctttctcgggatatgtatgtatgtttttgctttggcttcgagctcatcaatatgggtttgaatcagctcgagcaaatcatcataggattcagcatctaatatcgcctttgcctctgcggagaacgtcagcgtttcattgaatttcaggtagtcttcaaacgcaaaagcgccgtcaactgccaaagccgctgccgctttcagctcctgccatactctttcctcatcacgctcgtaaggaggaatgctttcttttactccataatggagaaaataaggcgtaagccctttatcgaatacaatgttttcaggagcgacaatcaaattcagcctagacagattgtgctgctgtacggcttgaacaagctgataggcaaactgccatttactttttttatccttagctttcatgaagcggaatgctttataggaggagggaggttggattgtgatgattacttcatcatccgtcacatcgatttctttatgaaaaaatggatttatatctttgatcacgttagcttcaagaccgtcgagaagctttattttttcccgttgaaaggtaaatgtatagccggcatctgttttctcggcaacagcttctaattggttttctaaatatgatttttgtttacctgacattcaaccagatcctttcataatatttcaagccggtctccgtttgtaatgccgcaatcagacagcttgcattctccggaaaacaccttatccttgttcaccactctgatccagtgcccttcgcgcggaggcatagatacgctttgggcctgccaagcaatatcaattacttttttcaccgggtggtaatctgacaatctgagatcaaagacactgccgttataatgtttcaaatctattgtaatatcaatatacatttaggatcacccttacatagaaagagcgccgtcttcttttgaatcaggcgctccttccctttcatactgttatccgcggatttgatttgcgatgtcttggtcagtagactcaagtgtatttgctgtttgatcaagctgctgattcacatcttgaagcaaatctgacattttgataaatgaaggtttgagctgctcgtattgatctgcgaacgcttcgcttgaagcaccttcccacatgcttttcaaatcagagatcattcggtttaaacgatcaacctgatttaatacttcttggctttcaacgccgtattgcttcgccatcgctcttagctcttcgggtgtgacacgaattaatcctgccatattcctcattacctcctgtgccatcagcctaaatatgggctaattcacttatttttagaacgtcattattataaaaacagtttttcggcatagtcaaacaaatatgttttaattttacaaaatgagtccaatggtttaccccgaatcacttaaaaatgacatataatgtaaagtaaataggtttattttcttaatctcctcttcattctccgaataatccaaaagacccaaataactctccaactcccaaaaaaaacctttcagaaaatttgatgctacagcaccatttctgaaaggttcagttttttctttccttaattagtctcgcctccgatgactttcttagaagattaataggataagctgtcgtattatatgaggcatacaactgtcctgcaaaaaggcgattacaccgccaaatgtatatagaacgtttctctcatgaaattgtttttttgcttctgttctttgttgttgattttcacaaacaacaacaatcataataaaaggaaggggatgagatgtcaaagagaaatcaagcacgaaaagtagggagatttatgaccatgccgaatgatccgtttaaatatagttttgacagacttgaagatgttgctgatcatatcagcgacgttctgcggtgcccgatcaccatagaggatgttaaccacaagctgcttgcctacagtacacacagcgactgcacagaccctgcccggacctctaccattattggcagaagggtaccggagaaggtgattaacaagctgtggaaagacgggacaattcctgctctcttaaaaacggaccagccgatcagagtcaagcaaatcgatgaagtcgggctgagcaatcgcgtcgctatttcgatttggaaaaacaagcaagtacttggcttcatatgggcgcttgagatccaaaaaacattgtccgatgaagatctgctgacattgcaaatggcagcaaaagcagtgaaaaacaagcttctcaaacttcaaatcagaaaaacgaaaaatgaagaacgcagccaagaatttttctggaaaatgctgaccggacacatccatcaggaggatgatatggcggatgggttccataagcttggaatggccgctccttcagagttttccgttatgatcatccgcataaatggcgagctgactgaaaaaatcgaacagcagctgcaatatttacaggaaacgacccagcaggtttacgtgctgctggcgaccgtagattccaatgaacttattatattaacctcacccaaaacagatcatccttttcaagatttaaaacagtttgctttaagtacgcaaaaacagctgaaggagcggtataaaatagaagacgtttctatcgcttttggcggaatatacaactctatttcttttgtctcccgctcctatcaggaagcattgtccgtcttaaaaacgaaggaacggttcactgaagagaccaaacatcttttcagcttttctgagttaggcatttatcaatacttagatgtcttatatgaaaaacggaaacaggtgggccattataattactcgctttccaaactggaacaatatgaccgggatcaccagtcaaatctggtagagacgctagagcgctttattgaagcggacagcaacgtgaataccgcttccaagctgttaaatatacacgttaatacgttgaattaccgactcaagcggatcagccagatcgctgaaattgatttgaaaaatgtgaatcaaaaattcaccatctatttagatatcaaacttcggcacatggatttgtgaaatttcacaaatccatgtttttttattttcttaatcaaacaaagaattttccaaaatatcaagctacactaaaaatatcacagatacaggaggagacagatatgatcataggggttcctaaagagataaaaaacaatgaaaaccgtgtcgcattaacacccgggggcgtttctcagctcatttcaaacggccaccgggtgctggttgaaacaggcgcgggccttggaagcggatttgaaaatgaagcctatgagtcagcaggagcggaaatcattgctgatccgaaacaggtctgggacgccgaaatggtcatgaaggtaaaagaaccgctgccggaagaatatgtttatttccgcaaaggacttgtgctgtttacgtaccttcatttagcagctgagcctgagcttgcacaggccttgaaggataaaggagtaactgccatcgcatatgaaacggtcagtgaaggccggacattgcctcttctgacacctatgtcagaggttgcgggcagaatggcggcgcaaatcggcgctcaattcttagaaaagcctaaaggcggaaaaggcattctgcttgccggggtgcctggcgtttcccgcggaaaagtaacaattatcggaggaggcgttgtcggcacaaacgcggccaaaatggctgtcggactcggtgcagatgtgacgatcattgacttaaacgcagaccgcttgcgccagcttgatgacatcttcggccatcagattaaaacgttaatttctaatccggtcaatattgctgatgctgtggcggaagcggatctcctcatttgcgcggtattaattccgggtgctaaagctccgactcttgtcactgaggaaatggtaaaacaaatgaaacccggttcagtcattgttgatgtagcgatcgaccaaggcggcatcgtcgaaactgtcgaccatatcacaacacatgatcagccaacatatgaaaagcacggggttgtgcattatgctgtagcgaacatgccgggtgctgtccctcgtacatcaacaatcgccctgactaacgttactgttccatacgcgctgcaaatcgcgaacaaaggggcagtaaaagcgctcacagacaatgcggcactgagagcgggtttaaacaccgcaaacggacacgtgacctatgaagctgtagcaagagatctaggctatgagtatgttcctgccgaaaaagctttacaggatgaatcatctgtggcgggtgcttaattcacaatgagcttgcagaaagatttctgcaggcttttttattttttaaaaggaaaaaagagaccatttcacgaattatgactatgaagttgatcataaaggaggattcatatggctgttcagcaatatggcgtgttaaaaggcatagtcttagacatgaagcgggaaacagatgatgacagtcctcatttccaagtcaaaatgctcggtgaagagaatacgtattacaggtgcgccatcaatgtgatgtccagttctgaggaatctgaagtattgtatttggctgacgatcagtttgattcgggctcaattaccatccttccgaacatgccgtatggatatacaaggatcaatgaagcaaaccgtgaagtggcactggattatgtgcggggcaatttgtttgacccgcgggaaatgaagcctttgcctcatgaaatcacaggacctgataatgatttaaatgattttattgaaacctatatgaagaaagcacaagatgagaaagcgccggtttatatattcggttcaaaattcggccctgaacaggctgcagataaaatattcggctttaccccgactaacggaatgcacaatatccatatgaatcaagggaatgcaatggatacgcgctggaaaaaagacaacggctcttggcatgacgggggtattctgattcagtttgcagatcagtgggccgctgtgtttttagcgtttttatcccaatcttggtgtaccgatgaaaacggaaacccggtcagagattgtgatcatacccaaacgtctgcgtaagattagaaaaagagactgcggcgagcagtctctttttgatacgattacacattttcaacagtctttaggctgtttggcctcatatcgctccaatgcgattggatatagtccaaacaagcttcacgccctttttgctcatgaacgactgtccagccgctcggcacatctataaaaccgggccatagggaatattggccttcttcattgatcagcaccaaatacgtgccatccgcattttcaaaaggatttgccactctatttctcctcccttatttattcaactcttccaatttgacagcgagaaccttgccgatttgagccagaggttccggctgacataaatctttatgacggcagtcgatgtcgatttgttcaatctgtccgttaatataaggcttccacgagtcaggttcaatcgggtcaaaccattcaggaatgattgttgatctgaaaaacaaaacatttccacggaaggttttcggcttataggaacctaaaatgccgacagaattgacatacgtattcttcaaatttaaaatgaccgtttcatccaggctcgcaagcgcactgccgtcacggcgaagaatctcaatcgccgcttcaaaatctagcggtttttcccctaagctgtctggatcatacccgcctaacgccagaagggcaataagcgcttcctcatcatccggtgcctcttttataggaaggaagtggttcggataggcgtccagcatcaccaacagggatacttcttctccttgattttgcagctgggtagccatcgcttgaacgacattcccgcccagggaccagcccagcagatggtacgggccttttggctggaccgttcggatttgtttaatgtaatcggcagccatgtcatcaagttgtttcggaagctcctcgcgctgcccgattccccgtgcctgcaagccgtagatcggataatctgttcctatattggtcatcaaaccggcataacaccagctgagcccccctgccggatgaacacagaataaaggaggcttgtctccgcttgttcggagcggcagcagaacgtcaagagcgctttggcttgatcccatttcaagtctttcagcgagcccggctacagtaggtgcttcgaacaagttgccgatgctgagttcaacgccgagcgcttcacgaatgcggctcatgagctgtacagcaagcaaggaatgtccgcctaaatcaaagaaacggtcatcaatgccgacacgcggcaagtgaagcacctccataaagaggtcacagagaatttcttcctgcggcgttctcggtcctcgtcctgtcactgccgctgcgaaatccggagcgggcagtgctttacgatcaagctttccattcggtgtcagcggcaattctttcatcgtcacaaaggcagcaggcaccatgtaatccggcagtctctccgcagcatatttgcgcagttccgccgtatcaaatgtttcttccgaagggatgacataagctgctaaccgtttatctcccggctgatcctcacgaacgatcactgccgcatcttcaagctgcggatgctgaacaagcgcggcttcaatttctcccaattcaatccggaatccccgaattttcacttgatggtctgcacggccgacatagtcgagagaaccgtcagcgcggaggcgggccacatccccagtgcggtacatccgggtgcctggaggaccgaacggatcagctatgaagcgttcagatgttaaaccaggccggcctagataacctcgtgctaaccccgctcctgatacatacagctctccggcaacacccggcggaaccggctgcaggcgttcatccagcacgtatacaccaagatcgggaatgccgcagccgatcaagctgtttgcccgtaaagctgccatgcttcggtctaattcgatatagctcacatgcaccgtcgtttctgtaatcccatacatattgataagctgcggtctattttcagggtggcggttgtaccaatcctctaaacggctgagttcaagcgcttctccgccaaaaatgacatagcgcagaccgagtgcctgtccgagatccggctgttcccgttccgcctgcataaactgatagaaagcagacggtgtctggttcagaacagtcaccccctctttgacaagcaggcgcagaaacgcttctggcgatctgctgacgtggtgaggcacgattacaagacgtccgccatgcagcagaggaccccagatctcccacaccgaaaaatcaaacgcataggaatggaacatggtccagatatcatctgagctgaaacggaaccagtgctcggtcgctgcaaataaacgtgttacattttggtgaggaatcatcacaccttttggaacacctgttgagccggatgtataaatgacatatgccgtattcaaaggcgaaagcggctgagtcctatccttattttttggattacctgcagggtacgtgtttagtttctctgccagctcgggatcatccagcacgattttcggcacgttttcaactggcggaatgtgatttgcagctttagtgttcgtcatgataaacgcaggctttgcatcttttagcataaaagcaattcgatcagccggataatccggatcaagagggagataagctgccccggcctttagcaccgccaataggccgacagccatttccaacgatcggggcagtgccaatgccacaaattgctccggcccgacaccttcactaatcagcattcgggcaagccggtttgctctttcattcagctctgcatagttcagtgcctgattttcatatacaacggcaatggcatcaggacgtaaagcagcctgcttctcaaattgctctggcaaacatgcgtgcggaatcttttcagatacactttgccaatcagtcaccatgctgctgcgttcctctggtgcaagaatatccagatttccgatttgcttgtcaggatcagactcggcagcctccaacaggcgcatcaatcggtcagcaagagcctgagcagtttcccgcttgaaaagatcagtgctgtattcaagcagtccttccatcccgtttggtgtcccgtcagcaaggcgatcttcactgatttccagcgtcaaatcaaacttggcagaaccgacactgttgattcgcaggctgctctccatatcaggaagatgcagttcagcgtccggtgtgttttggaacgcaagcatgatttggaataaaggatgcgtcgcacgcgaacgagccggattgagcacctctacaagtctctcaaacggcagatcctgattgtcataggcggccagattcactttccgtactctgtctagaagctcacgaaagcttggttcaccggacgtatcagttctgagcaccagtgtattaataaacagccctacaagatcgcccagcgcatcatcattccgtcccgcgatcggactgccgatcggaatgtcggtgcccgccccgagccttgtcaataaagcggcgagaccggattgaagcaccataaacaggctcaccctatttgcgcgagccagctcctgcaatcgcttgtgaaactcgggctcaatacgaaaatgaatcgtatctccatcctgactcggctcagccggacgtgaataatcggttggcagttcaagctgatcaggcaggtttttcaaggtttctttccagaaagcaagctgaccggcaatcaagctgtttggattatcctcgtttccaagcagttcttgctgccaaagcgcatagtctgcatactgcacagcaagaggcgcccattcgggagatcgtccgtggcagcgagccgcataagctgtcccaaggtctctggtcagcggtgttaaggaccagccgtccccgacaatatgatggacgagaagaagcagcacgtactcatcaggaccgatcacaaaaagctcggcacgaaaagcaggttcagctgcaagatcaaagctgtagcgtacagcttcggcaagccgatcagaaagctccttctcagcaatttcagtaacatgtaactcaggatgggcttgatcagcatctaaaacatgctgataggatgtcccctgtgattcagggaagatcgtccgaaggctttcatgacggcagacgaggtcataaagtgccgctttcagcaatccttgatccaactcacctgacaaacggacagcaaccggaatattataagtaggactcggtccttccagacaatgcaggaaccatagccggcgctgggcaaatgatagcgggatcttttcaggccgctcagctctctgcaaagcgggacgtgcactctgcgccaaatcaagatgggcagcgagtccggctactgtcggttcgtcaaagagcttggcgataccaagttcggctcccattacctcgcgaatgcggctcatcagacgggctgcaagaagagaatggcccccaagctcgaagaaactgtcatcgataccgacgcgtgccaaaccgagaacctctgcaaacaagtcacacaatatctcttcctgaggagtccgcggggaccgatcactgacagatgtgctgaagtctggtgccggcagtgctttccggtcaagcttgccattaggtgttaatggcagctcgtccatctccacaaacgccgccggtaccatataatcaggaagactagcccccatataacgacgaagctctgcagtatcaatagcaccatcagcgactacataagccgccaatcgtttgtctcccggctgatcttcccgtacgacaaccgaggcctgttcaatgtgcggatgattggcaagcacggcatcaatttctccaagttcaattcggaatccgcgaattttgatttgatgatccgcccgcccgatataatccaaagacccatcggcgcgccagcgggcctggtctccggtccgatacattctagttcccggcggtccgtatggatctgcaacgaagcgctccgccgttaaatcagggcgatggaaataacctctggccaagccggtgcctgcaatataaagctctccgacaacgcccggcggcaccggctgcaatccattatcaagcacatacacctgcgtgttccaaatcggtttcccaatcggaggaacgccctgcagcccttcttcaagaaaagctgcggcagaccaaatcgttgtttcagtgggaccgtataagttcgtgactgaacaatgaaggtcttgaagcgcctgcaaaagaccgctcggcagcgcctcgcctcctacaagcactctaagcccccgaagtttctcaggttcactcgttaccaaagcgtgccacagtgtcggtgtcgcctgcatgatgttaatatcgaaattttcaatcatttgagctaatgcctgcggctcacggatcgtttctttctttgcgatcacaatttgcgctccgctaatcagcggaagatataactccaatgctgaaatatcaaaagcgacagtcgtcacagccaacagcctgtcttcttctcctagagaaaatgcctcctgcatggacagcagaaaattgcttaagcttttctgtgtcacaacgactcccttcggtcttcctgttgatcctgaggtatagatgatatacgcgggatggtcaagagaaaccgatacatccggattttccggcgaatagcgttttataatctcctgtgtaacagcctgatcaagcacaagctccggtacagccaagttatcaggcagactggctgctatttcctcagtcgttatgatgcatgaaggtttcgcatcctccagcatgtaagaaatgcggttggctggaaactccggatcaagggggagatacgccgcaccagtcttgagcacaccaagcattgaggccaccatctcaggggaacgcggcagcgccaaagcgacaaattgctccggaccaatccctttttcgatcaacagacgcgcgaggcggtttgcctcttcattgagctttcgatagttgacttgaatgtcatcacacatgagagcgatacgttctggcgtaagaactgcctgcttttcgaacatgtcctgaaggctgaccagcttctcggattttgccgtctcattccatttagaaatgactttttctttctcctctggcaacagaagctccatttgcccaatcagcatgtcctctccggcagaagccgtttgcagcagctgcaggatacgctgctgatgaagcttaatatcagactcactgtatacctcgggattcgcatcaacatcaattcgcagcccgctgccgtctgttctgtcatatacattgattgatagatcatcaacaggaccggctgaaagattatgcgttgtgccccgggcgccggcaaagtcgagaccgtaatcaaacggcataagattgatttgagggccaaataatctatgattttctcctatcaatttcagatcgcgccgaagctcttcatggcgatacttatgatgtcgccgaatactgcggatttcccgggaaatttgctgaatcagttcagaaaagctcatcgaagagcttaccgtcagccggagcggaagaaggttcatcaccatagccgggacattcagtgacgcggaccctatccgacccatcatgggcagaccgagcacaacatcctcagagccggtcatacggtgcacataaacagctgacaccgcaatcatgacttcatgccagcttcctgagaaatagcgcgccgcttcttttaacgcgtttacatcagacggaggcagatatgccgtatgacgaagaaaactgttagatgttcttggcgcccgatcagccaagctcacaacttcaggtgcatctgcaaaacggtccagccagaattgacgatccttctcatactgctctgatccgcgataatctgtatcctcctccaaaatggcctggagagacccaaaggaacggcttttagctgtttgtccttttataagcgcagtatatgtacttgccacacgctgggctatcagggaaaaaccgaagccgtcgatcgctatatggtgaatgcgctgataccaaaagaaacgatcaggcccggcaataaacagagcttcattgaacaaagggtcataccctaaatcaaccggctttgctaaatcagctttcatccagtttaatgctgttttttccggatcaggctcagagctgacgtcaatgacgtgcagctgtacatccggagacgggtttatcatctgccaaggcccgtccatattttcaccgaagcggacatgcagcgattccgcttccttgatcacgtgccgcaaagcttcttcaaaaagagcaatattgattggtccattgatttctatatattccgctgtattgtagattggattgtccggatcaagctgctgagcaaaccatatgccagtttgcgccccggtcaaagaatattgaagatcttttgtatcaggcatccgtttgtttaccctccttttataaataatccgcgtttggcagcacttgctggctgcgggttgtgagcaatttctgccattcttcgatcgttgggcgttcagccaattccacgaaagtcacctctgccccttcacggcgccattgttccaccaatgtcatgatccttaccgaatcaagaccacgatcgagcaaatcctcttgatctgtgatgtcttccggtgtttcttgtagaagctcagcaatttgtttacgaatattctcacatgtaaacacattctttttgccagtgtttgctgacgttttttgaacgtctgccggcgcattctgcagctgatcaagaagactgtcagtcatcacggtaaacgcacagcgtccagccgcatagtccagcgccatttgatgtttttctaatgaaaaatcagcaactgcatctcccacaaaaaaggctttaatatcctccataaatgcttcacatgctgtaacaagacagccgatatgggcgtaaattcctgtaatgatcagctgatcgcgtccctctttgcgcatcatttcaagcagattcgttctcttaaacgcgctgtatctccattttgtcagcacaagatcatcatccttcggtgccagctcggttataattttctcctcataaggaccgctgtttaatcccgggccccaaaagtctgtcagcagcgcacggtcatccggattttggcttcccggctgtgcggtatagacaacaggaatcccaagctgaacacattgattcttcagctttcgtatattcgctgaaagctctgttaccggagacgctcccgctgtgaaagcatcgacaaaatagttttgcatatcgtgtattaataggaccgcccgatttggatcaggcacccatgagactttgttttgcggcatatcagacgctgtcggcatttgatacggctgaatggcaggtatagccatatgaacacttcctctcaaattgttgatttatttttttgaccctgcaagaagtttctcggaaatggcttcacgaagagcctttttgcttacctttcctacccctgtctgcggaaaggattcgacaaattcaactcggtcagggattttatatgccgccagtccgcgctctctcaaaaatgctttaagctctgcggcttttggggcttcatcccggggaataatgaacacacaagatctttcgccaagaaattgatcaggcatggagaccattgctgcatcatggacagccggatgcgccagcagatgattttctacctcttcagccgcaaccttttctcctccacggttaatttgatccttcgcccggccttcaacgacaatatagccgtctcgtgtcagcctgacgatatcacccgtacggtaaaaaccgtcctcagtaaatgaagcggcgttatgctcttctgccttatagtaaccgcgaattgtatacggtccccgcgtcagcagatggcctgtttcaccaggttttacgtcgcgatcatgatcatcccaaacacgcacttcatcatatggggacatcggttttccttgggtgttgacaatgatctcctcaggatcatccaatctcgtataattgacgagaccctctgccattccgaacacctgctgcagcgtgcagccgaaaacagcttttaccctgcgcgcggcttcagcactaaacttggcaccgccgacctgcagcacttgaaggctggataaatcatcacggcgtgaggatgccgcatccatccataccatcgcaagaggcggaacaagagcggttatcgtgaccttttcccgttcaattaaaggaaatgcatcatctggacttggagaaggagataataccactcttcctccagcgtataatacgccgagaacgccaggtgagctcagcggataattgtgtgccatcggcagcgcggccaagtacaccgtgctgtggtcgagccagcagacctccacactccgcttcaggctgtatatgtagtcatcgtgggtcctcggaatcagtttcgatagcccggtgctcccgccagaaagctggaggaacgccacatccgaagatttgacttcaggcagttttacaggttctgtatgcaaatcctccagcggcaaaaattcctctgcctcacctgcgacaatgacgtgtttcaaagtcggcagcttgctttgaacttgtctggcaagcgtacggtagtcaaaaccggaataagcgtcgggaatgatatatgcagccgcttcagcaaactcgcaaaaatatgtaatttcactgcttcgatgagaaggcagtgcgaagactggaagcgcccccagacggaatagcgcgaaaataacttcaaaaaactctttgatatttggcagctgcaccacgacacgatccatctgttgaatgccgagcttctgaaatccggcagccaggcgatcagcccttgtgtcaagctcttgatagctccaatgggtgttcccgcatgtaatcgcaatgcggtcgccatatttggctgcccggtctcttaacaaatctccaaacgtctcgccggcccagcagccattctttcgataggtctcagctaactcatcaggccaaggagtaaatcctttcagcatgttgtatccctccagcaattcattctgttcatatgtgatccacgcccattgcccgcaacattgtccgaaactttgcggacgtctcctgaagctcgtcctcgggctttgaaccggccacaacaccagctccagcatacaggcggagtgagcgttcttctgcttctgcacaacggatggtcacgatccattctccgtcaccggcatcgtcacaccatccgaccatgccggtaaagaaaccgcggtcaaatggttcaatgctgagaatcgcttctcttgcaagatcagtcggtgttccgcagacggctggcgtcgggtggagagccgccgccaattcaagtgcggttacagacgggtcggaaagctctcccttaatcacgctggacaggtgccacatcgtttccgttttgatcagtgaaggcttctccggaacctccagcgtccggcagaaaggtctcagcgctgccgcaaccgcgtcagcgacaaccgcgtgctcatgaagatcctttgcggaagaaagcaattcagctgcccggcgctggtcttcaacaggatcattactgcgcggccttgagccggctaatgggttggaaacgacctgtgttcccatccttgaaacgagtagctccggacttgctccgagcaatgttcggcggggagacgtttcctcctgactggacacgtctgcggcaaacgtgtagccatgcgagttatgctgagccagatggcgaagcaattcatccgtctgaatcggttcaggcgatgtcaaatgcagcgatctggacaggacgattttgctgagtgttccatcggcaatgcgcgccagcccttgttcaacaccatttttataatcctcaggttcaggaacaggctttatgtggtatgtatgcccagcctgttgttccttttcctcatgatcaaattgaagcggtcctgaccagcgcacttcttcaggtacaacgagccgcgctgcttttacttgatcaaaaggaacggccccgacaacaagcggccggctttgccctgattgttttgcctgacgtaacgcctctgcaattcggccagaaagggtttccatttggttttgcccgtctgactccggtacgatttcacatatgcctttcgctaacagtacacgatgaggagacgctaagaaaaaggcgcccggctgatattcatgaagcaaatgctccgcttttgtttctgttataacgttttgatccaacattctcatgaacctcctttaaattcagttacacgcctaaggtcgcgccgccatctacgcataaattatgcatcgtaatatgccctgcctggccagaaaccaaaaagagcaccgcatccgcaatatccgaaggcttggctagttttttgagcggaatccctgttttaaatgtctcaagtgatccttttatgacttgctccgctccattctcgtcggcccataatgaccactgcatgtctgtttccgttgatccgggagatacaatgttgcagcgaatattgtattctgcaagctcaagaccaaggcatttcgtaaacatcacagccgcagcctttgaagacgcatatgccgccatagatgttcttggtacaccggcagcattcgatcccactgttacaatcgaacccgatcttcggtccatcatatatttgctgactgaacgcgaggcgttaaatacgccagtcgaattcactgagaacgtcgcctcccattcctcatcgctaagcgaatggatcagtcccgggcgaaggacacccgctacattcactaaaatatcaatcggccccatttcacgttcgatgcgcgccgtgatctcgtcaatcgccgcgctgtctctcacatccgcaggaaaagcttctgcatggcggccttctgctttgaggctgctcacaaccttttccagcttttcaggattataatcaactgccgcaatatgtgcgccttgactggcaagcgtccgcgcaacagcttcgcctattccttgggcagcccctgttataaaagcaatgtttccctctataccctttgcattcatatcatcaattcctttcttcgctctaaatgccgaacagacatccagcgaaaaagactgctcgccttgaaaaacgcaatctattgataatgattatcattatcaattataaaaataatcatatccaaatgtcatgtgacagtcaaatataatttcagtgacaaatattttttaaaagcaaggctgagtatgtctcagcccattgatagatgcggtccgtcagggtgaagcgcaaaacgcagcgcccggctgaccaaaactggaagaactgaaatatgtccttctcctgaaaactcgcaaaattctgctcgtatgccttgttcagataaaacggccagccgctcataaagctcccttgcattatcattcatccggcttttatgatgctgctccaattctcctgcggcaagcaggatattgataggctgattgtttttcttggtgagagagacgaaatggtccgttttctcgagaataaacggtttattccaatgaatggacggacttcccgcgatataggtttgaaacgcatcgggctttgttagcagcacctgcagcacgaaaagccctccgagcgaatggccaaagattgtttgtctttttttatcaatctggtaatctcgttctatctccggttttaaatcctcttcaataaatctgaaaaagccctccgctccgccatgctccggccattctctgccgtcgggcctttccggcagcttcgattgggctgttggcattgtaaaatcccggtggcgtgctgaagagaacggctccgctgtctcatagccaatgccgacgattactgcagggatcaccccggttttttcgggtcggcgtccctgtattcgaacggcttccgtcatcgttccgaagacagaattggcatccagcagataaatcacaggataaccagcgggtggcggcggcgtactaggtttcgagataaaaatgtgataggtacggttttcattgcgtgaagacatcatacgcacttccgtaccaggaatcgtaaatgcgtttgatgtcccgccatttgtccggtctattgtttgctctttcatgtagtacgacattcctctccttaaactaaaccgcaatgtatgataatgattttcactatcaactagacacctcaaataataggttttcttccaaagaaagtcaactttttcccgaataaaaaaggcaccttgatcaaataaggtacctgcagactatcaatatggaagtaaaaacccaataaagatgcggattgtcctatttgaaatagaaccttaatcccatgtaaacctttgattttgccaaggatcgcctctcatgtgatagccattccgctcccaaaagccaggatgattttctttcgtaaattggatgccgcgcagccacttggcgcttttccaaaaatatagatgcggaaatacaccccgcagcggaaagccgtgttcaggggttaaaggttcgccattatgcgcataagccagaagggaagtttccgctaagaaatcatcaagcggcagattggtcgtccagccctcttcagcatgtaaaatgacgtagcccgcttcttcttttacacccgctttttccgctatatcacaagcccgcacgccttgccacacattatcaagccttgaccatcccgtgacacaatgaatgtcatttttcgattcataccgtggaaaggctttgacatcttcaaagcttagcagcatcggatggtcaaccaaaccgtacacttgaagattccatttcgtcatatcttcgtaatatgggacatctccggtatgaagcacaggaaatgaagtggtgacgttttgatttggcggcactcttccagattgatcggactgtcttgtttttccgaaatacatatgggcctcctttttgttaaccaagtttaaaatcatgttgacaatctttttgttctttattactctatgattgtgtatgtcaacctaagggggaacaacgatgaaacaacgtaaacttcgtgcgggagatatggcgctgattggcatgttcgccgcacttatggctgtcggggccaacattacatcagtagcaccctttttacaagtagccggcattccgctttcgatgcagccgtttttctgtctcttggctgctttgcttcttggcagcaaacgagcagcgattgccatgattgtatatgcacttgtcggattggccggagcgcctgtgtttgctcaattttcagcaggcttcgcaccgtttgcagggaaaagcggcgggtttattatctcatacatcccggcagcatttgcagcgggatggtttttagaacgaaacattcagccaagtaaaattcgatttctcattgcttcacttatcggaacggcgatcatgtatctcatcggcactacctatatgtatcttgcactgaagctgtggattcatacgccagtgagctacggcacggcttggggctttatgatttggtttatggtaaaagatacagcgctggctgtgatactgtcgtttatcgcaccagcaatctaccgctctattcataaagcaaccggctttaacagaaatcacatatcatctacgtaaaaaccgttctattggacggttttttatcataacgagaaaaggctccccagtaaaggggagcctttttcctataaaacaagcgctgcaatccagccaaagatgacaagcggaatattataaaatataaatgtcggcacacaagtatcccaaatgtggtgatgctggccgtccgcactcaaacctgaagtcggcccaagcgtactgtcactggcaggtgaaccggcatcgccaagcgcagcagcagccccgataatcgcaatcgttgccatcgggctgaatccaagctgcatgcatagaggcacgaaaatggttgtgataacaggaatggtcgcaaaagaagatccgatccccattgtaattaataagccgacaatgagcatcagcaatgcgcccaaggactgactgtgtccgataaaaccagctgacgttttgaccagtgactcgacatctccggttttcgtcaatacgtttgaaaatccggctgcaacaagcatgacaaagccgataaaggccattaaaaccattccatcagtaattagtgagtccgcttcatcacgcttcatcacaccgctgacaaacagaacaatcagaccagcgagcgcccccataatcattccttctactcccaaagtctgagataagtaaagctggacgccgagtgacacaacaatggctagaaccgcgataccaatgctttttctcgtatatggcgatgcttctgcacctgaaatgtcttttgtttcatattgtttcggtttacggtatacgatcactgataaaataaggccgacaaccatacctgcaactggaataatcagtgcgtacggaatatcagcaagcggaacgtttaacccagcatccgccatattgtccttcagcatgccttggaagatttggccgaaaccgaccggaagcaaaatataaggagccgttaagccaaatgtaattacacacgcgatcagacggcggtccatttcaagttcattaaagattttcaaaagcggcggaatcagcaccggaataaacgcgatgtgaaccggaacgacgttttgcgaaaaacaagatacaattaaaataatcagcacaatcagcaccttagacagtgctttttttcgagaatcttctttatttccgattaatttaacggaggcttccaccattgcgtccggaagacctgttttcgtcaaagcggcggcaaacgcgccaagcatggcatagctgactgcaacggtggcatttccgccgagaccgtctgtgaaagctttaaccgtttcaccaagaccgagcccgcctgttaacccgccggccaaggcgcctataattaatgcgataacaatattgacacgcagcaggcttaatacaagcataagcaggactgcgatgacgactgcattcatgatgatacccctccaaaaatcctttagtttgctaatgtagtagataaataaagtacgaacgtatcgtatcataaccgatccactttagtcaactaaagatttcggaagtaaaaatccctgccgcatcatacagcagggatttttcattactcgtttttatcttcttccaatgtaaatcgctccgcaagtgtagccagtgttcttgccataacgccagtagccccggccggtccgaagcaggttgctttattggcagtcgctgtgcctgcaatatcaaggtgaacccaaggtgttgactcagcgaattcaccaagaaacgttcctgccataatcgcatgtccctcgcgtcccggtgaattgttgagatccgccatttggctgcttttcacgcgttttttatccttctctgttatcggcagctgccagatcgcctctccgcactcttgtgcagcatcagctacctgctggtaaaagctttgatcatttgtcattgcaccggttgtttctgttcctaatgccacaacgacgccgccggtaagcgtagctacatcgacaagaactgatgcgccatgctgtttcgcgtatgtaatgccatctgcaagcactagccttccttcagcatccgtattaaggatttctattgtttttccgcttaaagatacgatcacgtcatccggcttcatggccccgccggagatcatattatcggttgatggaataacggccagcacgttttgctcgggacgaagctctccgatcgtttccatagcgccgagaaccgcagctgctcctcccatatctgatttcatgccgacaattccagatttcgttttaatggagtagccgcctgtgtcaaaggtaattcctttcccgactagtccaacgacgttttcccattcctttttgccctggtattttaacacaatcattttcggcggttcggtggagccttggtttaccgcaagtattccgcccataccgagctcttccatctctgatttctccaatatttcacactcaaaatcatatttcgccgcaagctcttcagcatacgaagcaaggtcagtcgctgtcagcatgtttcccggcatattcacaagcgttctagccgaatttgtcccttgtccgtatgcctggccgacgcgaagccccgcctgcacttcctgtgtatcttcatctgttacaacatacacggcttcaatttgtttgtcaggctcatttgatttgtgcttataatcctgcacctcataggaagcaagcaggcagctctcagctaaagcatgcgcggcatcggctggaggcacgtcttccgaaataaacgtatcaagcagaacagcagtttcttgttttcgatctttatgaatggcttgaaaaacatgagcaaaacgttccttcgcctgttcaaacgaataatttgcttctctccccagaccaacgaaataaatccgtttcatacccgcagaagatggagggaatacttttgatacttgattcggtttcgcagagacatcaccctcttttaaaagctgtgtcagatggccttcgagcatttcatcaatttccaacgcttttcctgtcagctggcttttttgaaaaagcccgaccacaagggtttctgtatgctctgattgttgaaccacataaaacatgaggcttacactcctaacgtaatgggtatttgtaatgaacaatggtataataggaaaaacattctttccactatacttattttaacaaacaacagtctaagacttgcttttttcttttgaaacacgaaggatttttcaaatagaaaggatgtcgccgatggaacttttaacgaattttcctttattatcaagcctggccgcaattatttttgctcaggtcatcaaagtgcccatacagtttatcgtgtccagaaaactggactggtcgctggtcacaagcacaggcggcatgcccagctctcactccgcagcggtcactgcactttcaacaggcgtagccttggagcatggattagactcctcactctttgcggtttccgccattttcgccgtcataaccatgtttgacgcaactggcgtcagacgtcatgccggtgagcaggcaacagtcattaataagcttgtcattgattttaaccgtttcgtaaatgaagcgaaggacttccctaaggctgcagagaaagaaaagcaaaaaaagctgaaagagcttctcggacatcagccgatcgaagtctttttcggaggactaacaggtattttactgacattggtactcgcttactttttcatgtaaaaaaacgctcctgctttcgctggagcgttttattctttcacagttttatattgatttctgaacacttgcaaagattttgtttcattgagcttctcaagctcatcctcggtaatttttcccgttccctttttaatcacataaacatcaagggtttttttgccccattcattgtatacatctttgactgtctcatagtacagatcaaggcggtttcccttaatagctgatcctgtgtcggccacaactccgagaccgtagttcggaatgaataaaattgttccgatcgggaaaacggacgggtcagcagcaaccgtggaatataaatcccgtttcactttcacacctgaatatgtaagcccgtataatggatcaccgggatttttgcccgtcgactcagctcctgctgtgtagcctgttgctgttactctttggactggatattcatcccaatcaaatgcctcttctaacggttttgttttatcctcagccgcggacgtggtttgtgtttgtttctgctgcaatgcttttaatgtcagtcctgcatgcttcaagtgcttttcctgatgttcctgcacccattttgacaagtccttcgcttcaattcctgacactgataaaaatgtcgtgccaaatgcaagcagaaataaacaggtcatcagcaaacgtctgatcatattcacatcattcacctctcctccgaatcattgttcccaagtggagagagcattattcaaaatgatgaatgagctgaacgcataaaaaaagctttctttagaagaaagcggcatttaaaacatttgatatcctctttttctgagcatgttgatcgctataccggacacgatggcgccggccaaaccgctgactaaaatcagcacatcagcagccgctaatgataagacacgatgaaacagactggcaaaggattctcccggcgactggacatagctgatcagcttttctttgctgataatgaaaaggcatacaattggataaatcacagccataatccaagacattctcagcagcatgtttaataagaaaccgattccaaaaaacaagacaaaaaacaaaacaattgagatgattacgactggcagactaatcaacctattccacccccctgcgttgtttttagtgtaacgcgggggctgaaataaagtcaacggctggaaaaagaatgactgtcttttcctgtcccctggcaagacggacaagtctctgaaccgccgagaatcaattgaaaatatccttttcctgaacaaaatgggcatgcatgtgaagcggttgtcgttgcagttttcatctaatcatcaccctttttcttaattttctgataatataccatatcaagctgtcaacaataaagtcagatcatgtgacaaatcttttgatgtaagcggaaacatacttgttttcctctcgttctctttttattttggcgttttttaataaagaaaacccgcttccgcgggtttttagaaaaacttgaacttgccttttttcaatgtcagtccgagtccgccaatcataaacagtgagcggttatcaatgacttttttcataaacgaagcgggcgtgccttttagctttctgccataaacaaccccaaccgcgttatgctcgccaagagaagccactgttcccttaatgtccggcttgaattcctcaagctctccgcctttaataagcctgccaaggtttttagcgaccgttatgccctgctgcattgcaatttgcgcagtcggcggatacgggcgctctgtatcttcattcataaacagcgagctgtcgccgagaataaagacattgtcatgtcccggggcgcggagatcaggattgactttgactcggccgcgcatattctcaaaaccggcttcctccacaatcggatgaccgcggacacctgccgcccatacaacggtttgcgatttgatctgctctggttcctcatcttttttgccgactctgactccttctggtgtacattcttgtacagccgttccgatcttgaactcaactccgttttcctcaagataatgtacggcgtaatcaacaagttccggatcaaagcccggcaaaacggtcggcgctgcttccacacaaatgatgcggacaaggcttctgtcaacgtcatattccttacagagctccggcacgcgagcagccagttcgccaagaaattcaattcccgtaaatccggcaccgccaacaacgatcgttaacctgtccggccgtttttccgcttccgtattgtaagtcgcaaactgcagctcaatatgttcccgcagcaggcgcgacgtgttgatgttggcaatcggaaacgcatattcttttaagcctttaatgccgaacgtttcaggcacggcgccgagcccgatgactaaataatcgtactgcagttctccattcgcaagcacaacttttttctcatcaattttgattgcctttacggtatcctgtacaaaattcacccgtgactggttgattacatcttttatctgataacggcagcggtcatgatggagcgtacccgcgctcgcttcatgcatccatgtcgtttcataatgataattgtgtttatttacaagcgtaatgtcagcatcattcggcccgacatacttcgtcagccttgtcaccgtcatcaatccgccatatcctgcacctaaaatcacgattttgggcttattcaatgccatcacatccaccttctctttttttgcttttgttagacccataataaaatcatcatttgtgttagcttcagcttattggcgggattttatgaaatatattgaaaagttttttgtgaagtccttacccgtagcactattatcatgtttatccggctggcccaagaaacattcagaaaaagatcatttcatttggttattatcgtagcggcctggggaaatattttcaagaacggatgggcacgttagatccttacgattttttctgctgactcgtcaatttgaacggcaatatggtataattaataacaattttcatttaggaggcaattttcgtatgcgagaggatacaaaggtttatgatattacaattataggcgggggaccggtcggcttattcaccgctttttacggcgggatgagacaggcaagcgtcaaaattatcgaaagcctgcctcagctcggcggacagcttagcgccctataccctgagaagtatatatatgatgtagcgggattcccgaaaatccgcgcgcaagagcttatcaataacctaaaagagcaaatggcgaaattcgaccaaaccatttgtctggagcaagcggttgaatctgttgagaaacaagctgacggcgtgtttaagcttgtaacaaatgaagaaacccactactctaaaacagtcatcatcactgcaggaaacggcgcattcaaaccgagaaagctggaacttgaaaatgccgagcagtatgaaggcaaaaacctccattacttcgttgatgatctgcaaaaatttgccggcagacgcgttgcgatccttggcggtggagattccgcggttgactgggcgcttatgcttgagccgatcgcaaaagaagtatcgatcattcaccgccgtgacaagttccgtgcgcacgagcacagtgtggaaaaccttcatgcgtcgaaggttaatgtcctgacaccattcgtccctgcggagctgatcggcgaagacaaaatcgaacagctagtgcttgaagaagtgaaaggcgaccgcaaagagattttagaaattgatgacttaatcgtcaactacggtttcgtttcatctcttggaccgatcaaaaactggggcctggacatcgagaaaaattccattgtcgtgaaatcaacaatggaaacaaatatcgaaggcttctttgcagcaggtgacatttgtacatatgaaggaaaagtcaacctgattgccagcggcttcggtgaggcaccgacagcagtgaacaacgccaaggcttacatggacccgaaagcccgcgtacagcctcttcactcaacaagtctttttgaaaataaataataaaaaaggagcttgtgtctgcgacacagctccttttttatttgaagatatttatataattcaatgcagttcctacaaccagcgcaatcacaagggctgcgactacccagatcattgccataataatgcggtcctgaatcttttgggacttcggtgttttttcttcgttttgggccatcttattcgctcctttcccatgtccatgccataaagaaagcctggtgctgaacgaccaagctttgctgaacgtatatcattcgcgttttgatccgctctctaagaccattcgttaaaactatgatacctaaactcaccctgcatgacaagcttcggcacttgcaccacacctgccagcaaatcataatgtttgacatcctaaataaaacagagtacattatagaaggcgaacatttcatatattatacttttaaatattcgtttttaggagtgaaaaccatggaaaacgtatttgattacgaagatattcagctaattcctgcaaaatgcattgtaaatagccgttcagaatgtgatacatccgtacgtttaggcggacgtacatttaaattgcccgtcgtccctgccaatatgcagacgattatagatgaaaaactagcgatttcattagccgaaaatggctacttttatgtgatgcaccgatttgaacctgaaaatcggattgattttattaaagatatgaacgcacgcgggttattctcttctatcagcgtgggcgtcaaagatgaggagtatgaatttgtccgccagctggcagaagaaaatctgactcctgaatacgtgacaattgacattgctcacgggcactcaaatgctgtcattgaaatgatccagcaccttaaaaaacatttgccggacagctttgttattgctggcaacgtcggaacgccagaagcagtcagagagcttgaaaatgcgggagcggatgccactaaagtcggcatcggaccgggaaaagtatgtattacgaaaatcaaaaccggcttcggcacaggcggctggcaattagcagcgctgcgctggtgtgccaaggctgccagcaaaccgattatcgcggatggcggcatccgcacccatggtgacatcgcaaaatcaatccgattcggcgcaacgatggtcatgatcggttcactatttgccggacacgaagaatcgccaggccaaacgatcgaaaaagacggaaagctttacaaggagtacttcggctcagcctctgaattccaaaaaggcgaaaagaaaaatgtcgaaggcaaaaaaatgcatgtggagcataaaggctcaatcaaggatacactgattgaaatggagcaggatcttcaatcttctatttcttatgcaggcggaacaaagcttgacgccatccgcaatgtggattatgtgattgtgaagaattccatttttaatggggataaatattaatcataaaaaaacgccaagtcagcggttctccgcttgagttggcgttttctgctacttcttcagcaaagtaagcttatatttgctttttgaatttatcttccatcagttctgccatttgttttgcatttggattttcttcattttgcaactgttcaataatgttcatataatccgtttcatttcggttctggcttaatttatatgccgcttgaatatcttccaccttaatcttaaatccaacgatacctttcaattcacgttctaagagttttggagaaagcttatcccataaaacaggattgtcacgatgtttttcgtatttctccagcatgattgttaattcttctgctaattcatctttctctaatatacttgcttttccatacatgtggacagcctgataattccacgtcggaacattttcacgcgaataccaggaagaagaaatataagcgtgcggtccctgaaacatcacaagcacatcttcacaggcttcaaacgttctccactgaggatttccataagcgaaatgccccgtaatatagtaatgatcgtcttttttattgaatcctaacggcaaatgtgtggcaattggttttccttgttctgttgtgacaatcgtaccaaaggagttttcttgtacaaaattccaaatttcttcagcatttgtgactttaaaatattttggaatatacatcatcatccacccttcgaaaaatattatatgagcgttttagccatgattaaatccgtttgctcttcatcacccatataaaaagagtgggcgccggtctgaacaaaccccattttcttataaaaggcaatggcattttcatttttttcccacacacctagccaaatgttctttttattacgttccagcgcaatttctatcgctttattcagcagatgtttgccaagcccatgtttttgaaagctgttctttatataaattctctcgatttcaagtgattcagcacccatttcttcagactgagcatcatcgatattgacctttacatatccagcgatttcatgatcaaagtaaacaaaaaagaattgcgaagacatattggataactctttttccagctgctcagtgttaaatgcgctttctaaataggctttcatattttcaggtgagttctgttctttaaaagtgtcattgaatgtttcaatactcaattgttgaagtgtttgtaaatcttcccggctgcattttttcatttttacactcattgttcggattcagcccctttattaaaaaatcaattgtcttgtgtccctttttaatatatctaaacacggaacagatactggccttgttaccagtccaaaaatcttcttcatcatcaactccctatcgttattttgttgtaaatgcaataaaatatactccgcattaaatatagcgtaactttgctgtatttacaacaaaaatcaaacaacaaagcagcgtttctcatgccgaagttcccggaactctctgcatcatttccccataataaaaacgcctcccttaacgatgatttatcgctaagaaaagcgtcagtaatagttgctatccgtttttagtgcttagcactcttcaggcttgcctgcattcgttgctgttctgaacgaagaaccgcagccgcatgaagcgatggcgtttggattgtcgatggtgaagccgccgccgagcatggattgtttataatcaatcacggtgccgttcatgatgtcaaggctttctttgtcaactagaacagtgatgccgtgctgatcaaacacactgtctgattcactcttttcatgctcaaagcccatgccgtaagaaagtccgctgcagccgccgcctttgacgcctacacgcagaaacgcgttttcttcttcatgctctttcatcatatcttttatatgcaaagctgctgcttctgtaattgttaccgggttgctcatcattgtgaacctccttttaaaaaccggttgctgtcttttattataaacatgatcgttccaattctcaaacaaggtgttttacaagaaatagacaccctcacaaacggtttcagccggccctgtcatcattacatggccgttatctttccagtttatcaccaaatccccgcctgctaaatgcaccgtgatgtcttgatttcgctttgatacgccgtttaatacagatgcgactgccgctgcacatgctcctgtcccgcatgcctgagtaatccctgatccccgttcccagacgcggaaatgcaattcttgttcattcacggtttcaacgaattccacattgatgccttccggaaatctcggatctttctcaatcaccggccccagtgtcgttaagggtgcctgttcaatgtctgcgatcggaaaaacgatatgcggatttcccattgaaacggcagtgcctgttagttctacttcaccaaatgccatcgtttcattgattgtgtgctcttccccgccgttaagcatcggaagctcggattttgtcaagcgcggttcgcccatatcgacagtgaccacattcacttttccgttttcgacttgaacctccgcttttacaagcccggagagagtttcaatcagaaaagatgtttcctcaaccagtttatgctcatatgcgtattttgcgacacagcgcaggccattgccgcagtttttcccttcagacccgtcattattaaaaatccgcattttgacaggcgcttggtctgatgggcatatcaggatcattccgtccgatccgatccctgtataaacagaagaaacctgaatagcaatctctgacagtttttcttctggaagctgttcttcaaattgattcacataaatataactgtttcccaggccgtgcattttggtaaatcgaaatgagttcataggtgcctccaactttttttctttttcttagtataaaagctattataagcggacacaatacaattatcccccgtttttcatacataaaagctccttgcactgacgcaaggagcttttatcgtttatataaacatgccggcaatggctgcgctgagcagattggctaatgttcctgcaagaacagccttcaggccgagacgtgcgatatctgaacggcggctgggcgctaatccgcccagcgtaccaagcataatcgcaattgatgaaaaattggcgaatccgcataacgcgaaactgataatggtagcagttttcttagaaaactcgccgatgtgcggaccgaagttagaataagcgacaaactcattcagcaccaatttctggccgatatagcttcccgcctgcaatgcttcatgccaaggcacgccaatcaaaaaggcgataggagaaaacacatagccgagaatggattctaatgttacgccttttaaaccgaacaagccgaaagccccgccgagaataccgtttactacagcgattaacgcaacgaacgcaagcagcatcgccccaacgtttaacgcaatttgcagtcctgttgacgctccctttgcagctgcgtcaatgacattggctgcgccttcgccttcatccattttgaaatcgctttttacggtttgcgttttttccgtttcgggtataatcaatttaccaaagactagtccagctggagcagccataaagctggccgccagcaagtattcaatcggaataccgagaagcgcgtacccaaacaaggtagatcccgctactgccgatagaccgctcgtcataatcgtaaacaactcagagcgcgtcagcccggcaatcaggggtttgatcactaacggagattctgattgtcctacaaaaatattggcagcagccgccagagattccgttttgcttgttccaaggagcttcgacaatccgccgccaatgacacggaaaacgagctgcatgattttcaaatgatataaaactgcaatcagtgctgagaagaaaatgataacgggcagtacacttaatgcaaatgccggactgtctccgacctttagaagcggtccaaaaataaaactgatgccttcattcgcatagtcaatcagaagctgtacacggcttgaaaaccataaaaaaacagcgcgtcccgcttcccatttcaacacgatgtatccaaacgccacctgtgtgcataaaccaacgatgacggttcttatcttaatattgcttttcttttctgaaaataaaaacgcgatagcaatgatcgcaactgcgcccagcagcccccacagaacattcatgaatactcgtacacctcttaaattttatttaaaaaaatatcttttatacgataacaataatattttttgatgtctacacatttttttagttcttttgtacggcaaaataaaaaagggcctgtccagacccttttctttaaaacattggattttcttcaataaaggtatatatattctcaacaagctcagcaggcgtttcacccatgacgacttctccgtttaccagagcgaaaagcgattccatgcatgtcccgcagtagcttaagcagccatattcaaggacatcaaggttgggatccttctccaaaatcgcccgggcttcctgagagccgtgagccagattgctgacacaaaattcaatcattggattcatgcggtttcacctcacatatgtccattatcgcgaatttttcactattcgtcaaagacaacggatgattcaaaatttattatcgtaacatattatttctcaaataacgttttactaatttgtgttttcaggctaaattgtaggttattttgaaactattattgtgattttagatcaaattcgatataattctagatgttattttacatagttcgtattttcttcaatgtatctatcatactcttcggattaaaggggaattcaaatgaaaaaattggtcttgatcggcggaggttacgggaacatgcgtgttcttcatcgcttattgccaaaccagctgcctgatgatgtttcaatcacgttaattgacagaaatccttatcactgcttgaaaacagaatattatgcccttgccgcaggcacaatttctgaccatcatatcagagtgtcattcccagagcaccctcgcctggatgtccaatacggtgatatcacatcaattgatattgtacaaaaacaagtgctgttccaagatcgtgaaccgatttcttacgatgacgccgtaatcgggctcggctgtgaggataaatatcacaacgtgccgggagcgcctgaattcacctacagtattcaaaccatcgatcagtcccgcgaaacctaccaaaagctgaataatctgagcgctaatgccaccgtcgccattgtcggagcgggcttaagcggcgttgagcttgcaagtgaattgagagaaagccgtgatgacctgaacattattttgttcgaccgcggtaatctcattttatcaagctttcccgagcgtttaagcaaatatgtacaaaaatggttcgaagagcacggtgtccgcattattaacagggcaaatatcacaaaagtagaagaaggcgttgtgtataaccacgatgatccgatttctgcagacgccatcgtgtggacagccggcatccagccaaacaaagtcgtcagagacttagatgtggagaaggacgcacaagggcgtattgtattaacgcctcatcataatcttccaggtgatgaacatctgtacgttgtcggcgattgcgccagccttcctcatgcaccgagcgcccagctggcagaggctcaagcagagcagattgtccaaatcttgcaaaaacgctggaatggagaagccctgcctgaatcaatgccgcagtttaagctgaaaggcgtcctcggttcactcggaaaaaaagccggcttcgggcttgttgctgaccgtccgctgatcggccgtgttccgcgtatgctgaaatccggcttgctgtggatgtataaacaccataacggttaatgatagagaagaaccgctgatcaagtcagcggttttctgtatacccatgcttctccatttcctcataaacgtcttttaattttggattgccttcaccgacaattttgtcttctacgagcacaagcggataaaaatactcgtcatttctgattttttccgcaagctctttcgcatgttcattgtcaggcggctcatgaatatcgatgtactgcatctcaaaaggctgatttggatattttcttttcagcgcagcctcaagccactcgtatgtatccttggctgtcggcatattgacacagctcgcacaaacggtctctgccccgtacacgcttagcatgactggtttcatcacttgtaaacacccccttctcctatgtaagtcctttcttttaagtatacagagccaaaggacgtttttatagaaaaaaaccgtttttgtgttgaagtctgaatgtgctataatagggaaagcaactttgcaaaccaaacaatagatttttattgttacactgaatataatggttttatgacgacgaaaggagcgaatgtcatgactgaagttgaaatgaaagaacaggtgcaggaagtactggacaaacttcgtccgtttttacttcgtgacggcggtgactgtgagcttgtagacgtagatgaaggtatcgttaagcttcgtcttctaggcgcatgcggcagctgcccaagttcaacaattacgctgaaagccggaattgagcgcgctcttctagaagaagtgccgggtgtcgttgaagtagaacaagtcttttaataaagcagccaggcggatatttgatcagcctggctttttttattagagatattggtcaaaccatgagctgatataattcaggcgcttgatccgctgtcttgggtgtccggtgcgtgacaaattgtgcgatgcattcggaaaacggacaagcttggtttccttgcccatttttttcagagcgataaacagctgctccgcctgctcgatcgggcatcggtcatcccgctcgccatgcagtatcaaaagcggtgtctccacgttttctgcgtattttaaaggagaccggtcccagagcttttctgtgtcctcaaacatgtcatgctcaagctgccagtctgtaaagaaatagccgatatcactgacgccgtgaaagctgatccagtttgaaatcgagcgctgggtgacggcagctttaaagcggttcgtctgcccgacgatccagttggtcataaaacctccgtagcttccgcccgtgacaccgagccgcttaggatcaatatgcggatctcgcttgatagcctcatccacagcttgcatcacatcgtcataatcctttcctccataatcccctctgaccgcatttacaaattcctgcccgtagccgtggcttcctctcggattgatataaacgaccgcgtatcctttcgccgccagcacctgaaactcatgaaaatatgtatgtccgtacatcatatgcggaccgccgtgtatgttgagaataagtggatatgttgtctcaccttccatttgtgcaggcttcatcagccagccgttcaccgtcacgccgtcttctgtagcatattgaatctcttcaggtattgatatcatatgctcactgacaaacttgtcattcgcgccagtcagctgtttctcttcctgtccaagcgggatactgtaaagctcactcggtctgtccggctttgtcacactggcaataaagtgctgttcatcaggtgaaagagaaaagctattgatgtactctttttccaggcgaactggatacacaaggccttcaatcgaaatataatagatgcccgtactgccttgatctgtgccgatgacataaaacccttggctgtcctttgtccaaatcgggcgctgttcagcaccaccgatcaatgaatctccaatcagcgcatccgctaaatgaacgtccagcatctcagtcagacatgtgaggcggccttgttcgatatcatagagccacgcctttgagagcgttgcattctgatattccttttcatttccaagcaaagcaagataccttccgtctggtgaaaatgaactagatccgaatgagccgcgatgaggtgtaacctgcttaagatctccagactctagtgacatcatgtaaacatcatgcggcttgctggcatcatctatttcagttaaattagctgagaaaacaagccatttgccgtcaggagaaaaagcaggatcaccatgatcagctttgtgacttgtcagctccttcatctcacccgactttacgctgacaagcacaagctgggcatacgcgcctctcgtcagccctttgccgtcccgtttgtaggagaggctttgcacttcaacaggttcatagctgtcctgctccgttttttctcggtcatcaatgctttctccctctcctaaactgacagtgaccagaatcgattcgccatccggggaccatattggctttgacacgccatacgggatatcagtcagttttctcgcttctccgccttcagcgctcatcatatacagctgtgccgcttcgccttctcgatcagaaataaaggcaagcgtgcgcccgtccggagaccatcttgggtcggtgcttcgcttttctccatgtgtccaaggaacagacccgcccgttttcgtttcatagatccatatatttgatgtatacgaatctttctcttgatttacttgtgattttacatatgcggcacgggtgccgtctggggcgtattgaggatcggtcacagagacaatcgctgtgatgtcgtctgcggttatcagctttttcatattcatctcctcctttttacatgtatttcgtttttctaaataaaaactcctttatctccagcaaaaaaaagcgccctccgctgacgctgaggaacgcttggcatgatctatacactttttacttgatataaaggatttcgctctattatacttccctctttcggaacggtcaaagcgtctacttcacaatgagggaaatgaagcgcgagctgttcttttagctcttctccctttcctttttcggtcatgacgagaatcgttgggcctgctccgctgagagccgttccatatgcgcccttcatctcggcgacgtgctctacttttgacagctcaggcacaagcatcgcccggtacggctgatggaacatatccttcttcatgattttcccgacaaggggccaatccttggacatgatcgcagcaatgaggatattgctgacagcacttgcttttacggcatcggcatatggaaactccttcggaagcacgtctctcgcgtctcttgtcagcacttcataaaaaggaatgacaacgactacgtcaatgtcagcattcgggacgcggatcatttgggtctcgtcatcctcatgcaggccgatcacaagtccgccgacgagagaagcgccagcattgtccgggtgtccttcttctagactcgctaaatgcagcttgtccgcttcagacagctttaagccgcataattcatcagccagttcaatggccgctacaatcgccgcggcgctgctgccaaggccgcgtgcaagcgggatgtcgctccacaccttcacatggacagggggcatttcttttccgtacaaatctgcggtccgtttagccacttgatagatcaggttatctgtacccgccggaattccggcgactgtttctgtttcagcctcaaaagaccatttgtcgctttcaaagacggtcagcttcaaatatctgctgagtgccattccgactgaatcaaagccggggcctaggttagctgtgcttccgggaacagtgacagagaacagcatgtcggcttcgttcatacacgggccgctccttttacatattcaaggatgctgtcttcatcagtcggcaatgtgacaggcttgatttctgaaatgtcgaccgctgtgttcggatctttcagtccgtttcctgttaacacagctacgaccttgctgcctttcggaatttctccggatttcacctgtttcagcactcctgcgatagacgcgcaagaacctggttctgcaaacacgccttctacacgggcgatcaactgatatgcgtgaaggatttcatcatcagtgacttcgtcaattttcccattggattccttggctgcctttacagctttgtcccagcttgccgggtttccgatacgaatggctgtcgctattgtttcaggattttcaatcacttcattgcgcacgattgccgccgcaccctcagcttcaaagccgcgcattttcggaaggcctgtgccgtttttctcatgatattccttgaagcccttccagtacgcagtgatgtttccagcgtttccgaccgggatcgctaaaacatcaggcgcttcccccagctgttcgcacacttcgaaggcagcagttttttggccttcaatgcggtaagggttgactgagttgacaagggcaatcggtgatttctcacagatggaacggacaattttaagcgcatcgtcaaagtttccgtcaattgcgataatctcggctccgtacatgacagcttgagcaagttttccaaatgcaatttttccgttcgggatgatgacaatgcatttcatgttagcacgagctgcatatgctgccgcagcagcggaagtgttacctgttgacgcgcacataatcgtgtcattgccttcttcttttgccttggccacagccataaccattccgcgatctttaaatgatcccgtaggattgacgccttccgttttgacatgaagctcaattccgagctgctcagacagcttcggcaggtgaataagaggtgtgtttccttcatgtaaagttagcgccggtgtttgatctgttacaggtaaaaattctttatattgctggataagtcctttccacattagctccaaccgttcccttctacacgatatgtgcttttgacttcttgaacgacttccaaatcatttaggttttgcagaatatcactgaaatcagcttctgatgtatgatgtgtgacaattacgatttctgctaaatcatcatggcctttaattggcagctgaaggattttttcaaagctcacgccccgctctgagaacacagatgtaattttcgagaatgaaccaacctcatcttttacatgaattcttaaaaactgctgtgcataaatgtcagacggcgatttcatgtttttctcatattgcggtccgacaaagctgttgccggttacaccgaggcgcatatttttcatgacagcgacgaggtcagaaacaacggatgtcgctgtcggcatgcttccggctcccggcccgtagaacatcgtctcaccgacagcctcgccgtatacataaacagcgttaaactcattatgaacagcagaaagcggatggtggtcaggaagcagtgtcggctgtacgctgacctcgattttgctgccgtcacgctgagcaatcccgatcagcttcattgtatagccgaggcgtttgctgaagctgatgtcctcgtctgtaatttgggagatcccctttactttgacgtcttccagatccacgttcatcgagaagccgaggcgcgccaatatcgccattttccgtgcggcgtcaagcccttccacgtcagaagtcggatcagcttcggcaaaaccgagatcctgcgcttccttgagcacttcctcgtatgggcttttctctttgatcattttggttaagataaagtttgttgtgccgttcacaattcccatcatttttgtaattcgatctgatgagaggccttcctctaacgtgcgcagaatcggaatcccgccggcaacactggcttcaaagtagatatcgcatccattttccttcgcttcagcaagcagctcggagccgtacacagccattaagtccttgtttgctgtgacaacatgctttttcgatctcagcgcgtcgaccaaatattgttttgtctgttcaacgccgccgatcacctcgatgacgacatcaacatctggatcatcaatgacatcatacacttctgtcgtgagcacttccttcggcaaatctacttctctctttttctctaaatcttttacaagcactttttttatcgtaaccggacagccgacctgatgcataagcttatcctgatggtcttgaataattttaacgacaccgcttccgacggtacctaaacctaaaagccctacacgaatcgctttcaaaaaaactccacctttcttttgattgtcctcttggaaaagacaattgttaactcaacacagacatataagttacaaacattatataagcccgctcctgttttgacaagacagcattaggctgaattttgcgaatgtaaacgcttaacgcattgatatgacaagattctttattttctaattatttttgtcagattttctcctcaccttgagctgcctttgccgagccagctgacgcgtggaacaaacagcttctgcgcccgcatattcatgaattcctgcgctgtattgagaaattgttcataacgcccacagtcattaagaatgaagtcaagctgttcttcaaaataatgcttttctgattctgatgacatgtaatagctttctacgatttcaaaataatgaagcgggaaaagcagacggctgtataaaaggcgtttcgaaaatgaagacagcggtgtgacttgctcgtattcctgtaaaaagagaaagccctgctgattaaaatcttgtctgtgatgcaaaaacgtatgcctcatatattcagccaaatcacgggaagcgtggtcaaacacccaatccgccggaatcctgatcaatgattccggtgaccatgtatgcctttccatccgctgatggcatatcgttcctgaatcagcggcttggggcttgtcatccagctcagtgtccactaaatattgtatcgcgttttctgacagtcctaaataatatggaaatgattcgatcatttttttatcgaatggctcatgcggaggggtctgaacctttctctgccagaatgcttccagctgatcaattcgttttccccacagatccttccactggccgattcttccggctgccttcacctcatatggatatcctcggccttttcggtgaaattccgcaagctccgctccaatggagaacgccctgtttgaataagggggggccgccttcagcagagcgtacgtttttccctcatgttcaaatgtcagttcaccttcttttgtaaagataaaaaccgaaacgtatgggtcactttgttcttgtaaatactgactcatgtaataaagctccgccagctctgtttctgagaattgggaaacggggacaatcagaaagtatgaattaggcgtctgaaagcattgatatgtgtgctggtacatggaaagctgcctgatgtgaatgccgtatttttcttttattgtacctttcaccatgatcacctgcctgttgaattagggctcatcacatcgtagtcatacacagccggaattatgaatacatattttaatccgaagaaggcgcaagaaaaagtcgtaaacttctcaagcattttgtataaactagtaaaaaagattgggtgaagctgatgtcagaaaacgaacaattcagtcagatggaagctaaagcaagagcacggatgaaggagcgcggcgttgaggtatcagacattgccgagcttgtcttttttctgcagaaaaaatatcatccggatttaaccattgatgaatgcacgctgaacgtcaatcgtgttctcgcaaaacgcgaggtgcaaaacgcgattttaacgggcattgaattggatgttcttgctgagcagaaaaaactgtctgaaccgctgcaaacgatgctggaaatagatgaaagcctatatggagtagatgaagttctggcattttccattgtgaacatttacggatcgatcgggtttacgaactacggttacatcgacaaagaaaaacccggaatccttaaacgattgaatgataaatcaaccggtgaatgccatacctttttagatgacatcgtcggagcgatttccgccgcggcttcaagcagacttgctcaccgcgcgcggcatacagaataagggcacccttttagggcgcccttttttcaaatgtatggaatccattcagtcagagagtcaatggcgtgagtcggtttttccatatcgtctgtcatatgttctcttttcgttacgcctgtgtgaacgagcagcgtatccatacccgcgtttatgccggccataatatcagtggcgtagttgtcgccgaccatgagtgtttcagacacatctgtgccgagaacgcgcatcgcctgctccataataattgattccggcttgccgataaatacaggctgtacacctgtagatacggttaacaccgatgtcagtgagccgtttcccggcagaagccctctttcagtcggaatcgcaatatctccgttagtggaaataaagcgggcgccatttctgattgccaggcagccgacagcaaatttttcgtatgtaatggaacggtcgatgccaacaacgacaaagtccgcgttttctccgccaaatgtcaggccgttttcttcaatcgcctggcggattccttcctccccaatcacatacacagacgcgtcttttttctgctgtgcaatgtgctgggcagttgccatgctggtcgtgaagacctgctcttctgttgccggaatatcaaaagacacgagcttgtccgctacctgcttcggtgtgcgcgaagagttgtttgtcacgaaaagataaggaacgccgcgatctttcagcgttctgacaaattcacacgcttcctcgattttttccgtgccattgtacatcgttccgtctaaatcaattaaataccctttatatgttttcatatccaacactcctgtggctttccagttgttatttaaacgcggaaacaggtcctagctctgtttccaaatagcttctgatccgtttcgggaagtcctgaagagctgtttgatgcgccttgatcagcctgtaaagctcgccgctgtcagcgagcagatactgttgaaccaacgttttgcggtaggcgatcaattttttgagctcatcaccctctttttccgtgacaactttctcatcaacaagtatatccataatgtcgtcatagctgcccgggtcccgcataataaagccgtcaatcatgtcattgcctgtatccaaaatgcattcgattaacagatggcctatacgctgaagtgccaattccccgatttcagactgccagtctgtttgtgagtcaaatagcgccagctggtgctcgaagaaccctagtgttttctcgattttgcttctgtcaacaaaatacatgacagcatcccctttgtgtatatttattttctgatccgtttcaagacaaaatacgcacagccgaaattgcagtattcgtaaatatattcatctaatgtgctgattttcgtttcgaaggttgccttttgattctggtcgtcaaagaagcccttgagccttagctgaccgtatccccagtctcccacaatataatcgtatttatttaatatatcggagtagcgggctttaaaagcctcttcgttgaagccgtctttgaaattgtgcaccaattcaaattcggcattttgaataagaatcatgatctcacctctttttcactcattcctatcataattcattgccccgtccccatcaattgctaaagaataaatcatgcgatttggctaccctacacatgaggagggatttataaatgaaacgaaccgctgtcagcctctgcctgctgaccggactattatccgggtgcggaggcgcaggattggataatgcccaaaatgtccggaatcagacgcagaatcaaaccaaacccattcatgtgtcggaccgcaacgaggcttttaacaggcataatgagaacgaacaatttggctatgtccgctatcaaaaagaacaatttgacggagaacagcagaaaacgccggtgatgaaccgggaagaaaccgctcacatgatatcaagtttaacggttcagctcccccatattcaagatgctgcgacattggtgactgaccgagaagcgcttgtcgtatacaaaaccgattctaaaaaccgggagctgaccgccgatcaggtgaaaaaaacagcggcttctgtgataccgcgatactatcacgtgtatatttccgataatccaaaccatatgcagtccgtcgaaaattacagcaatctcggctctggttcaagggatatcagagagatcatgtcggggacgattcaagaaatgaaaacctccccgcaaggaagccctgtctcagagaatgaaaatgccaatggaaaaacgcgtcaggacatgaaaatcgataggaatgacaaaaacgccagatgatctggcgttttggcattatgcttgggcttgacgctttttagatgcttcgtttacttgttcatccgcatggtaagaggaacggacaagcggaccggcttcacaatggctgaagcctttttgcatcgcgatttcttttaattctgcaaattcatcaggatggtagtatttttggactttcaagtgtttcttcgtcggctgcagatattggccgattgccataatatccacgttgttcgccaagaggtcgtccattacttcaataatctcttcttttgtttcgccgagcccgatcatgatacttgattttgtcggaatgtcaggctgcatttccttcgcacggcgcaaaaattccaatgaacggtcgtacgtcgcacgcgcgcggactcttggcgtcaggcggcgaaccgtttcgatattgtgattcaggatgtctgggcgtgtatccatcaaggtttttaggttatcatagtttccgcccatatcagacggcagcacctcaattgttgtgaacgggctttttctgcggatcgcacggacagtttccgcgaaaatgcctgcccctccatctttctgatcgtcacgcgcaacagccgtaatgaccgcgtgtttcaaattcataagcgcgactgaatccgctacgcgttccggctcttgcagatcaagctcagttggaaggcctgttttgacagcacagaaacggcatgctcttgtacaaacagaacctaaaatcataaatgtcgctgtacgtctgaccgcccagcattcatgaatattcggacactttgcttcttcgcatacggtatgcaggttgttttcccgcatgagttttttgagccctgtatagttttcatttgtatttaatttaattttaagccattcgggctttctgaggtgttcgtctttctttgccaattcccatcatctccaatatccaatatactcaatttctgacacgaaacattctgaaaacgagaaaggtgcagattttagttctgcaacaaaaataatgtttttctaactaaagaaagtcttttctttagacactttaacataggaaaaatttctcgacaagggaagatgattactgacatttttaagccgggttgccgcaaactatgtgtattcaatatgaaaggagattattttgtgaaagttttgttatccgctcttcttctccttttgtttgcatttgagccttctgcgtctggaaaaaaactttcagatccagtgctgtcgaaacggatggaattatatcataaaatcgaagctgtgacgcagatcccttggtatgcgctcgccgctgttgatcaatacgaagaaaacgtgcggagcaaccggaaagatctgcctgaaaaggcgggaatcatcagcatctatatacccgatgacatctggagcgggcctgaaaacccgaatccgaaagacgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgggagcgatatgaataccaaaaaaagaagtaacaaaaagccgcctcttcgacaggcggcttatttgctgcttttttctttttttgaatcagcaccgtcttcttctttgctgctcgggagctggacagaaggcgtgacacccgagccgccgcttccattataaaactgcggcacttcgccctgcactgctttaatcgatacaggaacattatttgtgacgacagctgttttgctggcaaatggaatgatgaccttcactttaatttcgacaaagatgctgatatcaataagtgcgttatttatgccatacggcttgattttggttttgacatctgtaaaagcgtcaccgattaaattgaaccggaccgggattttcggcccgaggtttccaagaaggctgttgccggttacctgtcccagcggaatgttgatcataatgttttcactggcgccgctgtgtccggtatgggtttccatctctttcaaatgagcttgaagctgctttgtcacttttgttttcacactgtttacaacctgtgtattaaaatcgattgtcgttaagtttccgttttcatcagaattcatttgaaacatatctttcatattttcactgtcagacatatagtcctcaatcgaatcctggatcacctctgtcgctatacgcttcgtttccatctcgccgatgtccattaaaacaggtttgatcgagccattgatcatccaaaggctgaccgttgttgacaggataaaaaagacaacggacaggagcatcacgtaacggaaaggcaaaggtcctctcttgcgaaaagggccgcgatatcttggcaagaaaatccccccttacatatcacaatgtatgcttgtaagaggggacatagtaatagccggagccaatttattttatttcaccatttttaaaagcgcttctctgccgctcataccgactttgatgccaagatcttccgcggcgtacgtgacggattctaaaggtgcgtctaacagctggtcaatggtgcggacaccaactgcgcgaccagccacaatgccgcgctcctttaatttttcattcagcagcgccacatcaagcgcgccgcacataatgtatccgtgatcattggtgacggccataaaattcgttttgggaagctttactgtcacagctgtaaaaggctgtccttctatcatgatcggtgtcaggtttaccacgtcaaccactcccttcattcatcactttatgatgaagggcacagcttgttgtgggctgactgccttattgcgcaagcttccaagcaagcagatcccgcaaaaattccggcataaaatattctttttctgcagcgtcgcgaatcaacggaaacagtttgccgagcgtaaacatatcaagcaccgcaacggagtattgtttatgtttttcaatatcttccccgttcagtgtgatccgggtgacgtgggtgatcccgtcatcgagccgtttcgtttctacctcaacgccggcatacaccattttccccatcacttctccgcggaagccaagtcctttgatccggagctgctccatttgttcggaagcggcatggacaatggtttccttcaattcttctcccgtcaggcggacagccaccgggttgatcggatgcggacagatgcggtgcagatccagctttgtcacaggacctgcttttagcggaccgagaatgacacctgaattgaccatactgatgtccgtctcgcaccattcctttaaggcgtatgccaaaagcaaaggcagctctgattcttcaaaccacttcacctcagcatcttgtgcaagctctgcaacggcatcggacagtttctcctcggcttcacgttctttttcattgagaaacgcttttgtttctgcggattctcctgtccattccgccatgttctgcacagaagccgttttgctgatgatgcttcgctgtacgctgtccaccgtgatttctacacagccgacataatgcccgtatttctcggcgctggccagcagtaccccattcaccacttgtccatcttcaagcaaatgatgggtatgtgattcgaggattacatcaatctcaggcaccgcttcagccactgcctgatcatcaagaatgcctaaatgtgacagcagaacgataatatcagcctgccctttcacttcccgaatggtttcctttatgctttcaagagcatccgttactgtccatcccagcttgtcatatacaggataatacggcacagttacacctaagaaagcaatggacataccgtttttcaatgatttgatatggtaaggcaccgcccaggacggacggtttccatttttatcaaacaggttagagacgatgacaggaaattcagcatgatcatataaggcagcaagctcttcatgcggaagcgtaatcccttcgttattgccgatcgccgctccatcaatgtgaaggcggtttaagagatcgacattcgcttttccgaatgtcgcctctgtcacgaattgaaaacgatcaagatgatcgccaatatcaaaaacgagcgtctcttcgccgtatgactgatgctcttttcttttctgctcgatataatctacaattttcggccagttttcaaaatggctgtgcaaatcatttgtatgatataagcggagcttctccttcataatatctctccctaatcgttcagctgaaaatgccttcataaatgagctggcagccgatcaaaatcaatacgatccgcatgatcataacgatcgttttcgtctgcatttttctgttgatggcggcgccaagctttccgccgaaccaagcgccgggcacaagcgcgagggcgtacagccaattgacgtgcccggaaatcatatgtgaaacagaccctgtcatagaagacaggaaaataataaacatggacgttgccaccgcaaccttcggcggaaacagaaataacagcatcatcgccggaaccatcagtgatccgccgcctataccgaaaagtccgcctaaaaaaccgacaacaaaggcaatggcaataccgacagaggcctgatatgagtacgtataaggctcaccggcatcatcctgaaatgtccggataattcctttgtgcgctttgttgattggccgggctttcgctttcagcattaaggataatgaaatcagaatcataaaaatgccaaaccaaacggaaaacgagtttgaattgaacagctttgacacgtaagccccgatcatgctgccgggacccgaaccgataaagaaaatgagcccgctcttataatcaacggttttatatttaatataagccaaagttgaagaaaggcccgtaaaaataatgaccaaaagcgaagttccaatcgcaacctgcggcgtcacatcctgaaacagctccgtcactgtgcttaaaaacatcagagacggcacaatgacaattccgccgccaagcccgattagacttcctaccgtacctgcgattaatcccaggacgaccaaaatcacaaacgacatcagtaaaaacctcttttctaaaataaatcgagctgtctcggagcaagtccgctgtactcgatatcaagcagttcaagcatctgcttgccgttatccgcggcgtcaccgccggaattgttgttgaacagaacaaaaacatccttacattgctgctgcaattcattcaggtgctttttccaatcctccagctcctgttggttgtagcggtataagtacctgacctcccgccagtttttcccgccatcaggcttcatccagccctgcttgttgcgtccgtgaaacctgacgagcgttttgttttcatcggtcgcgcgcaacacagtcggaacgctgccttctccgatttgcggttcatcacagacactgtgaatccagccttccgctttcataaatgaaagcgtctgctcataaaatggcggcgagaaccaggaacggtttctgaattcaagcgcacaagggatatctcccatttggtacttgcaccatctcaaataggcgacattctccttcttgcagtcaaaccaaggcggaaattgaaacagcaccatggcgagcttattgctatgtaaatatggcgttagagacaccttaaacgcatcaaacatctcctcttttgagtcaaagggaatttcgccgcgctgatgccctgtcatgccctgatatgctttcacgataaattggaaggtttcgggcgtttccttcacccacttttcattattgcgcgccggctgaatcgcgtaaaagctcgcgtctaattccacgatcggaaaatgggaggaataggcctgcaattttttctggctggccgttttcggcggatagatgctgtcatgatccccccaccccgtcagtccgatataaatcacactcattcacctctcttccagtttatcacacgtgttttcaggtttcctcggaaatgctgttcatatggcgggaaaatgcagaacgaagatgctgatattgttcctcattcgtatctaaaaacgcctcttctcttgaggaaggaatatgctgataatcaatagacgcctgaaactgctcactcgtaaaatcgtacatcacacccttgatgctgttgtaaaaatgccagctctcaccgacttttgttttgaaaatcgtgccgccgaaatggtcttgaatcaccaatgccgtcacgccgcattggccgcatgacgggcattcttccgtccatttagagctcgaatggcgcgaccaggattgcttaagtatgtatttgacatgttccattgcctccgcctcctttttaaaaaagataccacgttgataagattttaaaaactagaacagaggaaatcaaaaaacccggcggtaaaatccgccgggcttacgaaggaacgaccagagctccgtcaatttcagtgactttttccccatcattgtacacgcaccggcctttgctgtaagtggccgtaatgctgcagggaaatgtatgtccttcgtaaatgctttttttatgctttgcaaacatcgattctcttgtaacagtgtacggctccatgctgacgagcacgaaatctgcatcacaccccgcctcaagccgcccttttttctgaaggccgaatcgttttgcaggggccgccgctgtccattctgcgatggcttcaaacggaatctgatgctcaagcgccagttccagcattcctaataaagtgaactgcccgccgctgattccgccccatgataaaaacatgttatcctcccgcttcaaggatggacggcagggggaatggtctgaggaaaccatgtcaatgtccccggcaatgagcgtttcgatcagcgtctcttttgattgcagcgaccggagcggaggcgcgcattttgcgacagagcccctttgccgtaaatcgtcatggctgaacaagacataatgcgggcatgtctcgaccgaaacatcaagaccttcctgtttcgcctctctgatcagccggaccgctttcgccgtgctgatatggacaaaatgaaccggacagcctgtcaccttcgcatactgaatcgtgcgatacaccgcttcaacttctgcttcctccgggcgggaggcggcgtacgcatccgcatccacctttcctttattggccaaaaccatttgcaagtagcttgtgatcgcgtcgctttccgcgtggagagcgaggatttttcctgcagccgcgatttctgccatgcctttgagcaatgtccgttcatcaacagagcggaactcatcagtacctgactttgataaaaacgctttaaacccgatcgctcccgcttcagccatcggacggatgtcctcaatatggcctggcacaaggccgccccatagcgcaaaatccacggcagatttttgcctgcctagctcagcttttgcgagaagatgctctgccgtcacggttgatggaatacagttgagcggcatatcaaaataggtggtgcagccgcctgcggccatcatttgagaacctgtttcaaacccctcccaatcctccctgcccggttcattaaaatgaacatggcagtctatcacaccaggaaacacgtatttcccgtctgcctggatgatttccgtcccgcttgcttcaatgtcagaacctatctcagcaatgacaccgttttgaactgcaatctcagcttctataacgccatctggcgtaactgccttcgcaccttttatcaccatatcgtaagccatattgatccccccatgtaaggatgacgatttttcatgtcagtttatgtaacacaaccagttctattttcaacagtttactgctactatgatcgtattacatcagcaaaaccgctagaattcctattgaaaattattcaccttaaccaatgtttttatagaaaaggagaatgcgctatgaatatttttgatgtgatgaaaataccggcttttgaaaacgccaatttaatcgctggaaaagcaggaggggaaagagaggttcagcatgtcaatatgatggacgctccggatatcgcagactttttgcataagaatgaattgctcgtcaccaccgcctatcacctgaaggatcacccgcatcaattatctgaactgattcggcaaatggcaaaacgcggctgcgcgggcctcggcattaaaacaaagcgctatctggaagatatcccgaaggaaatcatcgaactggccgattcatatgcgtttccgatcattgaacttccggaacacatccgactcggcgatattgtgaatgccacactcagccatattctcgatatgcgttctaacgagctgcagcaagccatttacgcgcacaaaaaattcacaaaccacattatgagcggcaaggggctgcaatccctcctcaaaaaggtgtcagacctccttcagcttcccgtgctgctgcttgaccagcatgccaaaatgctgtctgcgtctcatcagatttcagttgagaccgaaaagctgaaaggcaccctgaataccgtatccgggccatttttcacttgtttctctacaatctcagatcagaaaacatattctgtcctgcctatttataatcacgaaaaaaactgcggctacctgctgataccggacatggtgcaggccggcgacaaaggattgatcctcacgattgaacaagcggccaacgtcatttcctttgaactgctgaaggaaaatgcgctgaagcagttcagccggcgggcccgcaatgagtttttcaacaattttattgagcggaccttttcttcagatgacgaaatcaaaaaccgggcgaaagaattcaagctgcgctgggatcaaaaatacatgtgcatcgccggcaaactcgatcgcaatgacgaatcaatcagctttacagaaaatcagctcgcttccgacagcgtattcgaatttcttgaaggtgaattatcagccttcccgtttccgcctcacttctttatgaaaggaaacgtcagcattattctaatcgaagcgacagacagctggagtgaaatgcacgcctcggtgatcagctttttagaacagttccaaacacaggtcagcgctcaatttaaacgaaccgtgtcctttggcatcagcaatatctgccaaaagctcattgatgttcccgacgctttcacagaagcttctgatgctctgcaatcggggcatttgtcaagaagcaccgcatttatccaggtgtatcacgccaaagatgtgcctgagcttctgcgcttgctcccggttgaggatttgaagaaattttacaactccacgcttcagagcctcgctgaaaaacagcaggaggatcaaagcctgcttcatacgctttccgtctatttagagacacactgccaaatttcagagacggcaaagcgtctgtacgttcatcgcaatacggtcatataccgccttgaaaaatgcgaagagcttctgggtaaaagcttaaaagatcctgaaacaacgatgcgtttgcggcttgccttacgcatgcagcggctgatcagctaaagtttgttacattttcttacaaaacgaatcgtttttcgtcactttcagcaatcacacctgtctttttcagctactgtatccaatgacacccctcgaccggcacgatattatgttactaaagttcacatacagggagggactatagtgaaaaaaagatcgtttaaggtgtttacgcttagcctgcagcatgtgctcgccatgtatgcaggtgcgattttggtgcccctgcttgtcggcagggcgctgaatgtaacaactgaacagctgtcctacctattggcgattgacctgttaacatgcggcgtcgcgacgcttttgcaaaccttgcgcggagcatacatcggcatcgggcttcccgtcatgcttggcagttcatttgtggccgtcaccccgatgattgcaatcggcagcaattacggcattcacgcgatttacggttccatcatagcggccggtgtgttcatctttttgtttgcgcgttttttcggcaagctgactgtgttatttcctcctgtcgtaacaggtaccgttgtgaccttgatcggcctttcacttgttccgacaggtgtgaaaaatatggctggcggcgaaaaaataaacggcagcgccaaccccgaatacggttcgctcgaaaaccttcttctctctgtcggtgtccttgttctgatcttagtcctcaaccgctttctcaaaggatttgcccgaacactgtccgttctgatcggcatcgccgccggaacagcggcagcagcgatcatgggcaaagtcagcttttcttctgttacagaagcaccgttcttccaaatcccgaagcctttttacttcggagcccctgcgtttgaaatcggtccgatcttaacgatgctgatcgtcggaatcgtcattattgtggaatcaaccggcgttttttacgcaatcggaaagatatgcggcagacctttaactgaaaaagatctcgtcaaaggctatcgagcggaaggaatcgccattctcatcggcgggctgttcaatgcctttccttataatacctttgcgcaaaacgccggcttattgcagctgaccaaagtgaaaacaagaaacatcgtcgttaccgcaggctgtatccttgtctgtctcggactgattccgaagattgccgcccttgcatctgccgttcctgctgctgtacttggcggcgcgaccgtcgtcatgttcggcatggtgattgcctccggcgtcaaaatgctcagcacagcggatctcaaaaatcaataccacctcctgaccatcgcatgctcaatcgcactcggcatcggcgccagcacggcccccgggatttttgctgaattccccgctccgatccggattctggtcagtgacggcaccatcaccggaagcctaaccgccatctttttgaatctatttttcagcttgcgcgacaaaaaagaattaacagcacagcaaacagaacttccggtattagaacatacactcgcattagaaaaagaggtgtaaaaaagatgaaggaacagcacaatgccttacaactgatgatgctggggcttcagcacatgcttgccatgtatgcgggagccattctcgttccgctgatcgtcggagcggcgatcgggctgaatgcggggcagctgacgtatttaatcgcgattgatttgtttatgtgtggggcggcaactcttttgcagctctggagaaaccgatatttcggcatcggcctgcccgttgtgctcggatgcacgtttaccgcagtcggcccgatgatttccatcggaagcacttacggtgtcccagcgatatatggtgccattatcgccgcaggactgattgtcgtcttagccgcgggcttcttcgggaagcttgtccgtttttttccgcctgtcgtaaccggatcagtcgtcatgatcatcggcatcagcctgattccaacggcaatgaataacctggccggaggtgaaggaagcaaagaattcggctcactcgacaacgtgctcctcgggtttggcgtcacagcttttatcttattgctattttatttctttaaaggctttatccgctccatagcgattttactcggtcttatcgcaggaacagcggctgcatatttgatgggaaaggtcgatttttctgaggtcttggaagcgtcttggcttcatgttccgtctctgttttatttcggaccgccaacctttgagctgccggctgttgtcacgatgcttctcgttgcgattgtcagcctcgttgaatcgacaggcgtttattttgccctcgctgatatcacaaaccgcaggctgtcggagaaggatctggaaaagggctaccgggcagaaggccttgcgattttgctgggcggcttatttaacgcgtttccctatacagctttctcgcagaatgtcggcatcgttcagctctcaaagatgaaaagtgtcaacgtcatcgccatcacaggaatcatactggtcgcgatcgggctggttccaaaagcagcggccctgacaacagtgatccccaccccagttctcggcggcgcaatgatcgtcatgttcggcatggtcatttcttacgggatcaaaatgctatccagtgttgaccttgattcgcaaggcaacttgctgattatcgcctcttccgtcagcttggggcttggcgctacaacagttcccgcgttgttttcatctcttccgggcgcggcctctgtcttggcaggaagcggaattgtgatcggcagtttgacggccattgcactgcacgctttttttcaaaccaaacagtcgaatggcgcagacataaaaacgtaaaggaagatgccaatgttcacaatggatgacctgaaccaaatggacacacaaacactgacagacacacttggctctatttttgaacactcttcatggattgcggagagatccgcagcactacggccgttttcgtcgctttctgatcttcaccgcaaaatgactggcattgtaaaagccgcggatcgcgagacacagcttgatttaatcaaaaagcatccccggctcggaacaaagaaaacaatgagcggtgactcggtacgagagcagcagaacgcggggctcagcaaattagaacagcaggaatacgaggagtttctcaagctgaatgaacactattatgatcgcttcggctttccttttattttagcggtgaagggaaagacgaaacaggacattcaccaagcccttctggcaaggcttgagagcgaacgagaaacggagttccagcaggcccttatagaaatttaccgaatcgcccgctttcgtctggctgacatcatcactgaaaaaggagagacgcaaatgaaaagaactatgtcttatggcaaaggaaatgtatttgcataccgaacgtttttaaaaccgctcactggagtgaagcaaatcccagaatcatcttttgccgggagaagcaataccgttatcggcgtagatgtgacatgcgaaattggcggagaagccttcctgccatcatttacagacggagacaacactctcgtcgtggcaacggattcaatgaaaaactttatccagcgccatctcgcatcctatgaaggaacgacaaccgaggggttcctacactatgtagctcaccgatttttagatacctattctcatatggacacgatcactctgactggcgaagacattccgtttgaagcaatgcctgcatacgaggagaaagagctcagcacaagccgcctcgtcttcagaagatcgcgtaatgaacgaagccgctctgtgctgaaagcagaacgaagcgggaataccataacgattacagagcaatacagcgaaatcatggatcttcagctcgtcaaggtgagcggcaactccttcgtcggcttcatccgggacgaatatacgactctcccggaagacggcaaccgcccgctgtttgtctatttaaacatcagctggcaatatgaaaataccaatgacgcatacgcttttgatccagcccgctacgtcgcggctgaacaagtccgcgacttagcgagcaccgtttttcacgagctcgaaaccccttcaatccaaaacttaatctatcatatcggctgcagaatattagcgaggttcccgcagctcactgatgtcagcttccaatctcaaaatcacacgtgggatgcggttgtcgaagaaatcccgggctcaaaaggaaaagtctacaccgaaccgcgcccgccatacggtttccaacattttaccgtgacaagagaagacgccgagaaagaaaaacagaaagccgctgaaaaatgtcggagcctgaaagcctgatgggaaaactgacaacccatattttagatttaaccagcggcaaaccagcggcgaacgtaaaaattgaattgaagcggctgggcgaaagtattttgaaagaggtttacactaacaatgacggcagagtcaatgtccctctgctggctggtgaagagctggtttccggagagtatgtgatggaatttcatgcaggagactattttgcgaataaaaacgtgaatacggtcgaccagccgtttttaaccatagtcaccgtccgttttcagctagcagatccagatgcacattatcatatcccgctcttgctgtcgccgtttggttatcaggtgtatagggggagttaagaaggaagcccgcctcaccggcgggcttctttttgcacttcaataaacttttgatcctaggacagtacttgaagtgatccccacacttagtgaaacaacagctagaataaacattcacctatatttttcaggataattgcctacgagaaaaatatcctgtagtcctttcatttataaatcgaggtttcaaactaataagtcagctcttagcagccgagctcccttctccaatcctataaacagaccgcgttttttctcgaaaaaatactctgaagacaattgctgcgtttttaatagttttgataacgcgttctctcttatacctttagacaaaatattcattttttcttttttagacttaaatctatgtcgaaaatgatcgttggcatatcttatactatctccactaaggaggtgacattatgggattctacaattctggtggatacagtggaaactctggttactcaaacggtttcgggagctccttcgctttgatcgtggtgctattcattttgttgatcattgttggagcagctatctttaattattaagtttaactttccttgcctccgccgtatccaacacctccctgtccgacagacgccataagaagtttttatggcgtctttgctatgtgctcactaatctttttgtaattcagaagctgtcaagttctacgagatttatcgtgtgttttcccacaacgcttctgcgtcttgatcgcgctgtctgactgaggctaaaaaagtccggcttttaaaagccggactcccgtctacccccgttcaactctcttctaatcctgcaagctgaccgcataatcccgccatacccggtacaccggcacaaattccccgccagcccttcttctatatcttcgtcagaaggttgaggggtttcccgaaacagtgctttaagcgcaattatcattcctggggtacagtagccgcattggaagcctccttcttccaaaaaagcggtttggcagatatccagttcctctttttgtacgccctcgattgttgtaatggagtggccgtccacttgataagccatggtcatacacgcattggccagttttccgtcgattaaaatagagcaggctccgcagcggccgattccgcaggacacctttgtcccggtcagctgaaattcctttctaagcaggtcactcagatgtgtcgtaggaacggcagcaacctcccactcctgcccattcacggtcatccggaactgttccttttttacaggaaatggcccggcctcttttacgtccattgcttcagcccctttctgtcgatcgcttcaagcagctcttctcttgaaattggcagcttgtttatccagcatccgaccgcatcatgtactgcctttacaatcgccggagtgatggcgattgttccgatttcgccaacaccgcgcggtccatatgcatcacccttcattagttcttctattgcgatcaccttcatgtcaggaacgtctttgactccagggatcaaatagtgatctagattttctgcggcataacggccgtccgtcattttcgcttcctccatcagtgtgtagccgagtgccatggcagcgccgccttcaatttgacctcgatatccctgcggactgacaaccggacctgccgcaatagcgtgctcacaatctatcaatttgacatcgcctgttaacagatctacctccacctcaacggcagccgctccaaatgagtagaggaaatggccgcccaccacaggatcaggcgttgttggaaagtcaaaggccgtttcctctgccaaagggcctttttcagccagctccttatacgtcaccacgagcgcctttgtgtttttgtcacgcaagcctgcagcgccgggaataagattttccgctgaacagccgttccattctgccgcccgttttttcaactgggctagaaacggcttcttcaaacgctggatcgcgtgccacaccatgcttgtgccgcgggatgctgtggaggagcctgacttcggcacttttgcggtatccccaataacaatggaaatatcttctgcggcacaacctagctcctccatgacaatctgttcaatcgctgctagaatcccctgtccgcattcttcaaatccgaacgatgctgtgattttgccttcactcgaaagggacaaacggcctcctgccgcatccattcggccataccccagcccgccgccgtgcattgtaattgccgctcccgtgcctctttgcagatacccgcagttccggctggttcttgtaagaatgggagatttagatatggcattcaacacctgtgccgctccgtcagttggtgcaattcgatgctcaagcggccccaagtcatgcggttttctgatattttttcttctcagctcgagcgggtcgatgccgagcatgccgctgagacgatcgagatgggtttcgagtgcaaatgtgatttggttgccgccaaaaccccgaaattcccccgccaccccgttgttcgtaaatactgatattccttcagtccggatattcggaatacggtacggccccgcggcatgctcgacagaaaaatcaagaacagccggtccgagcgtagcatatgcgcctgtgtccgccacaattttcacgtcatgcgccaatagatttcccgaatgatccgcacccgtttttatcgtaatcttcatcggatggcgcttaatgccagaccgtacagattcctttcgtgtctgatggattttgacaggacgtccgcttttcagtgacaaaagcgcgacatacggctgaatattcagctcatccttccctccgaacgagccgcccatcggacttgacacaatcctgatcttctcttcaggaatgtcaaaaatacgggcaagctggaaacggtctttatagccgtgctgggttcctgcatacatcgtaaaccccccgtcgtcttccggaacggctacgcctccctccgtttccatatacgtatgcatctgccgcggcagctcataggtttcttcaaggactgtgtcagatgcttgaaacccttcttccacatcaccgtttgaaaaaaatgcgcggtgcaggatattcccgtcctcatgcagtctttgcgcattcggccgaagcgctttttctggtgaatccatgacttccagctctttatactcaactcgaatcagctccagcgccgcttccgcgatttcttccgtttccgcagcaactgcggcgatcgcatccccgacataccgcaccctgtcctcacataaaaccggctgatcagggatgacaatgccaaatcggtttaagccgggaacgtctttatgtgtgacgacggcctgcacgccttccattttctcagcttttatggtgcaaaccgacacaatctctgcatgaggataagcacttctcagcaccttgccatacagcattctcggaaagctgagatcggtcatatatttcaattcccctgtgaccttatcccttccatccggcctgactcttgacggtttgttgatgatcatttattcccctccctcagccatcagctctgccatgatgacgttggcagcggctttttttctgtatgccgctgacataaaagcatctgaggaaaacggcagctcatggataagtgttttgtacagctcatgcgagtcccaccctggtgccatccatttcgcttcgctgtccaataatctcctaggagtgatatcggcatggccagcggcgaggcgaatgccgccgtctttcaaaaaacgtccagctgcaacagcagccgctcctgtaaaagcctggcgccttccaagcttgtgataaaatacacgctctccctccgcccgcgggatgatgacacgcgtaacgatagccgttctaaagtcttcctcactgagccaagcgccaagcggcagcctgattagctccttttgatatacgataagctcagcaccaagcacaagcagaagcggaatgaaatcaccgattttactcgctatgttgccgccaatcgtggcacggctgcgaatccccggtgcagcgacagcggaagcagcgtcactgaaacagccaagcgcgctcttgatcaaagggttctttctgcattcattcagtgatgtgagcgccccgatcgacacgtgggtgtcactggcgctgatccctcgcatctcgtcaatcccttcaaggctgacaaggtgctgtttcggcagagttcctttgtcccactgaagctgaagcagcgtgcttcccgatgcggcacacacatccggagcaagcttctctaaaagcgaataggcctcatcaagcgctgtcggcctccataattgaatattcatccttgcttttgtcacttggccgttcaagccatcgccctccttaccatgtcatattcctcgggtgtatcaatatcgtccaactcgccgctatcctttgcctccaaaaccgctcctgctccaagctgtccgcttttcaggagcctgcgagccccttcatctccctttaacccctttacataaggaaaacatgtcgacgagaagtagattggcggggtgaacgcccctaaaaacgatgacacggcaaatgactcaggggccagtgccacaagggcattgagatgatcgacggaaagctgaggctggtcggctaacaaaatgacaacgccgtccgcccccatgctttctgcttttctcaccccgctgccgactgaatgcccctgacccttttctgcgtcttggcaaacgtgcaggctccagcgtttttgaaaaggcggagcgtgatacggcgctcctatccactcaagggaggcatgttctgtccgctcgacgaccagcacgtgatcaaggcgggacgacagagcagttttcaaggaaagtgagccgatgttttctccttttagcggcaaagccagcttgttttggcccattcttctgcttttgccggcagcgagaaacacgccgatcagataggggtttctcatacaaccgccacccgttttcttgtttgaataatttctgcaactacacttaccgcaatttcctctggaccttccgcaccgattttcagcccgaccggactgtaaaagtgagacggaggatgttttccgttcagcagccgtttcgtgcggtttgccgaacccaacagtccaatataatggaggttttgagaaaataagaagttgatgatcgtttgatcgtgctgataatgatgggttgccacaacagctgcatcatgcggaaaaaattgaaatttgctaagcatttgttccggaaaagcggtaatcagctgatccgcttttggaaaaagagaggatgtacaataagcgggccgccaatccgtcacgattacagaaaaccctgtgtcagccgccaaattggccagcggtacagtatccggtcccgccccaaacagaatgaggcgcggcttcggttcaattcgctgaataaacatgttagtgggtcgatcgaaatgcggtaaatgaagcgttgaaacagtacgttgaatagcttgcagaggcgcgtccggccagttgccaaaatgcccgttctccatcagaaataaataatgggaggatccaatctttgtaacggaagtgacagctttgcctgattgaaggcagtccctcactttttcatagtgccgccttttttcctgagtgattcgctctgcatgaacatgaataatgccattgcacccggctcccatgccccaagaaagatcgtcctccgaccgcatgtcgtagggaatcagcgttgatgtgagctgatcgcccagcgcactgattctttggaatacatcttcttccacacacccgccgctcagcaagccaatccgtctgccatttttcataaagagcatagaggcgcctgcttttcgatacgcagagccttccacttgaacaattgtcgccagtacagcctcctcctggtcttccaggagcgcatctaacatcgtgtaaaaattccccaatgccgcatcctcctctcgaaaattgccgtgagattcaactaattccgcgtgattttatgggtaacttgtataaagaatagacgatggaagaaaaaatgactcatgatttgtcagaaaatgaaacacatagaaagaggatttgtaaaaagagtcaaacgaagaaaattagattggagaaaacacgaaatcatatctaaaaagcttgcggagttccgcaagcttttctttacaccgctgcctggcggtcagcgttttcatacacatccagcgctgcttggagcgcttttcctgcttcgattcctgcgttatgtctaagaagcacagcctctaacccggcaagcacgaatagcacgttttcttttctgcagctgtaccccatcgtgccgattctccagatcttccctgcgagcgggccgaatgagctggcgatttcaatgccgaattgtgccaacagcatgtcacggacagactcgccgtcaatgccgccgggaatttcgacacaggtaacaacaggcattttgcagctgtcatctccaaacaatcgtagccccattgcctttatccctgctgctaatgcggcttcatggtgccgatgccgctcgaaacgcgtctcaagaccttcttcaagcaccagtctgactccctcacgtaaggcgtacagcatcgtcgtcgcttctgtatgatgattgagccgtctttcgctccaataatcctcaagctggctcaaatcaaagtagttgcttgtgattggccgatttcccgaaagcgcttccctgtcagcttgtgacgcaatcccccgctccacctttttacgagctgcaatcacgtccgccacccgctcattatatgtaatcggcgccattcctgagggcacagacaaacacttttgcgttccgccgatggcagcgtcaatcttccattcatcgactttaacctcgcagcccccaatcgttgcgactgcatcgacgataaacaatgcatcctcggtgcggcaggcttcgccgatggctttcagcgggtgaatccgtcctgtcgatgtttctccatgcaccattgccacaattttcggcttcactttttttatctcccgtatgatgtcctccgggtcaaaaaccgttccccattcgcactcaagcatatgaacatttgccccatatcgctctgcgatttcagtcagcaaataaccgaaacggccgtaaatgggaatgagcacatcatcttccggctctatcacactagccagcactgcttcaattcccgcccgtgaagtgccgtcaatcgggtatgcccagcggttttttgtttggaacagctcccgaagcatctccatcgtttcattcataatacctgtaaacgccggatcaaattggccgacaaccggggtgctcattactcttaatacacgcggatcaacctcaacaggccctggcgtcataatcgttcttaacggggtgcataattctcttctgcctgacacagccattcctcctttatcagtaagccagtttatataataaatcagtcagtgcgcggacgccgatctcaagctgtctggctgacgtatattccttcggtgagtggctgacgccgcctcggcttggcacaaacagcatacaagcaggatagcgccttccgatcatttgcgcgtcatgccctgctccgctcaccatttcctcacagctgaagccgttttctaatgctgtttcaaaagccgcagccttcagcctttcgtccatcggcacaggctctatccgcatatattcatcaatcacggcgcgaattcctttttgtaggcaaatgccgttgatcaaagcaaccatgtcttgatgaaactgctccagcacgtgctggtgctgatggcgaatatcgattgaaaactggacgcggcccggtatgacattggctacattgggctctgccgttatttttccgcatgtcagacggagctcatccggcagctcctccgaccgcagcaacagctcatgaatgatacggctgctggctgcgagcgggtccttgcgccatttcatggaggtggttcccgcatgattgcattccccctccagcgtgacgagatatcgcctctgccccgcaatgcttgtcacaatcccgagatcccgtcccgacatttccaatgtctgtccctgttcaatatggagctcaacaaaagcgctgatatctgtccgatatgctgcctgaaacacacctttgccaaaaccgttctcatgcatcgcatgttgcagtgagactcctgattcgtctcttggctctgctccatcctgtaatgaaaaaacacccgtcatattccctgatccccaataggtcattggaaaacggctgccctcctcctcacataaagataccgcttcgagtgtttttttcggcgctccatatgtctctttgagccgctttatcgcaagcattgccgccagaacaccataggcgccgtcgtattttcccccattaatgacagtatcgatatgtgaaccggttacaatgacttcatccggagactgggtgcccgaaagccttccaaacacattgccgacatcgtcgaatcttgtatcaagcccgaaagaagacatttccgtttttacagcaagctgtgcgtccatccactcttttgtgtataaaagcctcgttacgccgccatccgcagacgcaccgtattgggcgagccattcaatataatctgtgatcctgttttttactgaaagcttctgcttttccatgtactcccccctctggccgctatggtgacttcattatagaaggaggaacatgatagttcattgacagattaaccaaaaaaacgtttattttttagtcacagtatctatccagcaaccagattcaccctacaagtcacaactattttgatgtaaagctcaaaagaaaacacggtaaggaagagagccagcaagagcgaaagagagggtcaaaatgcctttcatatgaacaagctaagctggagaggcgatggcgcggaacggatgaaaacagaaatgccggcagcccgcaaaaacaggacctaaagatatgggaacaggagatctttccgcctcctccaaagggactaatttacaattttaatgaaaaatatacaaaatgacacttctatcctttatttcaattttagataatagacatgatctgataaaaggagggcaagtgatgacaaaaaaagcatggtttctgccgctcgtctgtgtattactgatttccggatggcttgcaccggcagcttcagcaagcgcgcaaaccgcattaagccttaatgaccgattggcgtcttccccttcaggaacaggaagccttctctcattagccgcccccgctgcaccctatgctgacacagatacctattatgaaggggctgaaggtaaaacaggagactcgctaaaaagcaccctgcaccgtattatcagcggacacacgatgctgtcctacagcgaagtgtggaacgcgctgaaagaaacggatgaagacccgagaaatccgagtaacgtcatcctgctctatacgaatgaatcgcggtccaaaaacctgaacggcggcaatgtcggcgattggaaccgcgagcatgtctgggcgaaatcccatggcgattttggcacgagcaagggacctggtactgatattcatcatttgcgcccggctgatgttcaagttaacagcgccagaggaaatatggattttgacaatggcggcactgaatatgcgaaggcacccggaaattattatgacggcgattcatgggagccccgcgatgatgtgaaaggcgatgttgcccgcatgctgttttacatggctgtccgttacgagggtgatgacggctatcctgatcttgagcttaatgataagacaggcaacggctcagctccttatcatggcaaacaatctgtcctgctcgaatggaataagcaggatccggttgacgaccgcgagcggaaaagaaatgaaatcatttatgaaaaatatcagcacaaccgcaatccatttatcgaccaccctgaatgggcggatgagatttggccgtaagaaaaaggtgctccttttaaggagcacctcagattcttgccaaaaccctaaaatggttttcattttagggttttggcatcttttcagcgtgattgaaaacccttgaagactaggaaggacgagcataggagcggagcgaatgttctaattcgtgagcaccgaagcgcagtcctgacaacgaatgcgagggtttgtcgacacgctgaggtgccctttttaggagcacctttttctaatacacagcctcttccgtttccgcatcgaaaaagacgacgtggtccattttcactgagagctggattgaatcgcctgcatcgattcgcgtgtttccgtccaggcggaccttgagccgctcgtccccagccatgacatgcactatgagctccgagcccagattttcattcacttccacgttcgcttgaaacactgaatcaaacaactggtcatttcctgtcatttgtgtgatgtgctccggccgtacaccggcaatcatctgttctccggcatatcccttttccttcagccgctttgctttttcttcaggaatatgaagccggatcgaagaatttgtgaaaaacagctcgccatgctgctgttctatgatgcctttcaaaaagttcatcccaggagagccaatgaagcctgcgacaaacaaattggccgggtaatgataaatgtcatgaggtttcgccacttgctgaatttccccttcattcatgacgacaatccgatctcccattgtcattgcttcggtctggtcatgcgtgacataaatgatcgttgcctctaatcgctggtgcagcttgctgatttctgtccgcatcgtcactcttagttttgcatccagattagaaagcggctcgtccattaaaaagaccttcggctccctcacaatcgacctgccaagcgccaccctttgccgctgcccgccggagagcgccttcggttttctcttcagcaaatgttcaatttctaaaattctagctgccgcatgaacccgctcggcaatttcctgtttcgccatctttctgagctttaatccaaacgccatattatcaaaaaccgtcatatgcggataaagcgcatagttctggaataccatcgcaatatcacgttctttcggcggaagatcattgacccgctccccatcaataagaagatttccttcagaaatgctttctaatccagccaccatccgcagcgttgttgattttccgcatcctgacggccccaccagcaccaaaagctccttatcctttacatctaaatcaaagtccttcacggttaattgtgagtgatatgattttttgacgtgttcaaatgttaatgaagccatcagaaaagtccccctatcttttgacccgttatttcgtcactggaaacaacttggtctttctgttatttttagagtaatcgattcccatttttgctatatttctaaaataaaaaatgtaaatttgtattataacgtcataatacattataatataaataataggttaaaaggaggctaccctttgttaaacaacggaagttctacacctttatacattcagctaaaacaaatcatcactgatgacatcaaaaagggcgtgtattccccaaccgccaagctgcctaccgaaaacgagctttgcaccaagtataacgtcagccgcatcaccgtcaggaaagccattctcgatttagtcgaagaaggctatctgatcaggcagcagggaaagggaacgttcgttaaaagccctaaattaaaacgagagctgatcgctgtaaacggctactcggaatttatggaatcaaccggcaaaaaaccgaagcatcatgtgctgtcccatgacatcattccagcgtcaaaacccatcgcagaaaagcttcaaatccatcccgagagccctgtcgttgaattaaaacggattttatataatgatgatcagcctctcacctttgaagtgacgcattatccgcttgatttgtttcccggcattgatacctttattgctgacggcgtctccatgcatgatattttgaaacagcaatacaaagttgtacccacgcacaatacgaagctattaaacgttgtatatgcccaacaggaggaaagcaaatacctggattgtgatatcggggatgcgctgtttgaaattgataaaacggcttttacatcaaacgaccagccaatctattgctcattgtttttgatgcacacaaaccgtgtcacttttaccatcaacagcccctacacataacaggcataaaaaacgagacactgcttatagtattctcgttttttcactgcttcccccgtcctccaagcgataaggatagccatagccgaaagctccgtacacaccgcatgttttcgcagccgtttcggcggcctggcgcaaagcgtacgttatatcctgcttcacgcaaaaggcagtcaaaaagcctgctataaaagaatctcccgccccaagtgtatctattatatcagcttccacaatcggctgatgatagactcgatcacccgcagacaggattgctccttggccccctcgggtcatacaaaccattttggctccgtatccatgagctgttttggcaagctcaccgcattccgactcactcaaatcgcttcctgaaaaaaacgcatacgtcacataaggacagaccctcctcaaataatcatcctcccgattggttgaaaaatcaaatgagacagggaccagcccgcacagctgcggaagatcgttctcaagcctgctgtacacgctcgtatgcagcagatcatgcccgctgataaaagatacatctttctcctgaaacgcgaggcgaagccgggactgaatgccgcctttatttgacctgacaaaaatgcggtccccctgttcatcaagggtgacaatcgccatcccgttttctccgtgcgcctggcggatataatctgcattgacctgctccagcttgagaacgttcaacagatgcgccgcggcttcgtcattgccgacgattccgatataggaagactcatgcccgagccgcttggcaagcacagcaacgtttaaggcatttcctcccgggtagaatgtttcttgatcctggtaataatctacaacattatctccaaccgcaatcaatttcatagtgcttcctcctttatccttttacactgccgcttgcaatcccgcggacaaaatatttctgcatcaataaaaatagaataataatcggcgcggctgaaatcgttaaccccgccagcaggacgccccagtctgtctgcagcgcgtctctgaactgcatcagcccggctggaatggtccgcaaattctcatcatctatgaaaataatcgcaaacataaactcattccatgtatggtaagccgtcaaaatgccggatgtcaccaaaattggcacgctcattggtaagaaaattctgaaaaatactccaaaacttgtacacccatccaaataggccgcctcctccaattctttggaaatagaaagaaaataagagcggatcaaaatgatggtgaatgggatccgataagccgcatacggcaggattaacgcccaatacgtattgtacaggccaagcgactgaataatagaataaagcggcacaagactgacctgcggcgtcagcatcaatccgccaagacatagcaccaaaaagaatccttttcctttaaactcaaaccgggaaaggccatacgctgcccatgcactgataaagacagtgatcacacacgtcagcgccgtaacgatgacactgttcataaaataagaagaaatcccctggttccaggcggaaacaaaattttccggatgccacgaagacggcagcgaccagctgtgctcaaaaatatcgtcagagtttttaaaggcgctcatcaccatccagagaagcggataggcaatcgcaatcagataaagaaacagaaaaacccacacagacgtttctccgatataccattttcgtctaggcttatctttaacctcaatgtgctggtcaggcacaggctccaatctgaacgaatctgtcttcttctgaggcagcatcagttactcctcctttccggttttaaagaacttcatttgcatgagcgataatgcaagcgtaatgattaacacgacagtggcaatcgctgaggcgtagcccatcatatcctttgtaaaggcgcttttatataaaaacgtgctcaagacttctgacgcgtttcccggcccgccgcctgtcaaaatgtacggctcattaaagaccgtaaaggccccggtcagcgtcatgaccaccgcaacaaaagacatctctttcgtctggggaacagtaatatgaaaaaactgctgaattttacccgcgccgtcaagccgggccgcttcatacagttcatccggtattttttgaatcgacacgatgtacagcatcgcaatataaccgacagattgccactgggacacaaaaatgacagaaagcatagctgtgctgtcatccccgagccaggccctcgtcagctgatcaagaccgatggcctgaagcagctgattcaacagccctgtctccggattgtaaataaaatcaaacaaaagcgcgatcaccgtcattgagatgacaaccggcaaaaagaaaacggtacgaaaaaacggcgaccattttctgaccagcttatcctcaagcaccgccgccaaaatcaaacctccaaatacctggcatacaattgagatcactgcataaagcacattattggtaagtgcctgatagaagacaggatcatgaaataattcaacatagttttttaagccgataaacgttttttccggagaaaatgagctccactgaaacaggctgaggaatacattctcaaaaatcgggatataaacgaaaagtaaaaaaacgagagcgggcaccaaaaacaaataggggattattttattctgattgaccaagggtatctcatctcctttataaaaagaaaaggtgcgaagcttcaccttttctttgatttattcagctgacgccctcacctgctttgctgccttttgaacggctttcatcacctgctgcggtgtcatgtcgccgccaagcatttgctggacgcctgttaggtacgcatctgcgacttcaacatcgacatccatatcaaaccatggaaccattgatttggcatcaacaatatgctgaacggcttcacgctgaatagctgttgcattttcttcagtagccgtaccttgcactgcactgtatttcccgacatctttcacgagcttttcgcccatttttttcgacgtcaagaactgcaaaaattccattgcttccttcggatgttttgttcttgaggaaatcatgaatccttccggcgctcccgttaacgcttctgaagatcctttctgcccgctgatttcaggaaatgggaacatcccgagattaaccggttcaaccagcttgatttccgctgtttccgcatatatcatcgccgactttccgctcttaaattgctgtctcacatattcgtggtcgacggagtttacatgtttattaaagtaaggcatcagctcttgaagcttttcaagtgcttttacgtagccttcatcagtaaattcacccgttttggcgttatagtccttgtctcgcgttttttcatcgaccatccgctgattaagcgtgccgatatagtgcgagattgtccaagtcgcctttgttccgaagctgatcggtgtgtagccatgttctttcagcttttttgacacatcgattaattcatcccacgtcttcgggggatcaagattcatcttttggaaaatgtctttattatagaagaatgatttagcgtccatttgccacggcacgccatattgcttgttttcataagtaaatggtgtaatttgcgattgaacgagctgtgatgaccaatcggtgtcatttttgtagtaggacgagagatcaagtgctttattgcctctgataaatttaaaagcaaactcatcgctccaagagaagtaaatgtcaggagggctggtagttcccagcatgaccttaattttatctttataggagtcatttaaaacggcttcaatttgaatgtcgatatctgggtgatctttttcaaattcttttacaacctcttcaaaataacttttttccggctcctttggccatctgtggaaaaatttcaatgtcacctttccgtccgctgaactgctttggctcgaacagcctgcgatggtgagcatactgacagctgcaatgatcaagaacaacaacattttcttcaaagggttggcctcctctggacattagactataatgttatataacattatagtctaatgcataatggttcttcattttcagatcaatactcaactttccacatgtatcttctatgagataaaggatgatttctcgcctctgccagctcgtctgcatagcttctcagcacacgattgagaacgagcggagcaaggtagcctttaactgaatcgtcaattgcagtgaagtcgtaagatgcagcatcaagcacagtgagctttttgccatactttttcgagaaggtaagcgcccgctcttcaagaggtcttgtttcatctaaaccgagcaggatgataaacggcacggattcatcaataatttcaaacggtccgtgaaaatattctccggcatgaatggcgtgggaatgaatccattgcatttccatgagaatgcagatgctgtaggagtaagcgacaccgtagtttgcaccgcttgccatggtataaataatgctttctttttcatgggcttttgcaaattgcttggcgttgtcagcttcctgcttaagggctttttcatatacagcctgcaattgatctaagccttcaattgcttgttggaatttcgtattgttttctaatacttgcagggttccaaaaacgatttgatacaaaacgccatagtttgtattgatcgcaagcgcctcatcaccccaatcgtactgggcaacatattgcgcttcctgcgctaaaggagactccggtttaaacgtcatcgcaatcgtaagtgcgcccttgccccttgcaaacgcagcagctttgactgtctccggggtatttcccgaatgcgaacacaaaataacaagagacttttcaccaagctgaacagggttgcgctgaataaattcgttggcgctgtagaggtcggagtttattgattttgactctctgtcaaacacatacttactcggatacataatggcagaagaccctccgcatgcgacaaagaatacatgatcaatggttttccctttcaaatcctgcaagaaagcttgaacctcacgatttacttttgctgtggcctgactcaaatccttcactccccgtttttattatataacgttatataacattatatattgttatattaaagtccgcgggtaggattgtcaatattattttctgaaatttctcaataatttattcgaatgacagacaaagggtctatatgcgaaaaaatgcccaaatcaaaagccagaacttgacttaagctctggcttcgctgttcaatccgcagactgacgtcttatttaaaaaataccttgtctatattgtacttcgagtgctgtgtattgatgatatatgtttcgtaaatctctctttccattggatcatcaactacacatacctcgattttatagacttcatctctgtgatgtttgatcggtgaaacagtgtcttcgaaatgcttcttaattctctgtcttaactttctggctttaccgacaaacagcagctcgtcatgaatgttgtaaaacataaaaatgccgcctttgtcccttgggatctggtgaaagtcgatgaatccgtgaatcggttttatcttcggctcgttatcattagctgactgctgtcgttcagtgatggtgacattcggtgcgggtatatcaatttttatcaaaatcagttcacgtcctctttttcattaaagataaatgctaacacatacagaaaagaaaagctagaacagctttattatatttgtttgtcatgctcttacttattatgcaagtgctccggctggatcataaggactaaggtctaattctgtctgctttctgagaactagctttgcgagctctgcacctaagaacggccccatcgtcagtccagaagcgcccaaaccgttagcagcgtacaggccttgaacattcggcacagcccctatgaccggcagaaaacccggtgtaaacggcctgaagcccactcttgtttcaacagcagccgcatcagcaagacccggtgcaacggctaacgctttgctcaatacttcgtgctggcctccggctgtcacacgaagatcatcaagaccggcatcgttttcgtgtgtggcgccggctacaattctgccgttatcaaacgacagaatgtactgatcactcggcggcattacaaccggccacgatcctgtatctgcatctgtcatttcaaaatgcataatctgcgctttttgaaatgacacttgaaaatgaatgccaagaggcttcaatatctcattggcccatgctcccgccgtcacaatgaccgcgtcagccgcaaactgctttgtatctgtttgcacgccggtgactgttccgttttcaaaaagcaaggacgcatttcctttgatgaccgttgcgccgcgtttctctgcagcgcttaaaagcgaccggcacagcgctcttccgttcacacgggcggcaccgctgatatgaaccgattcatagccgtcagctaaaatcggaaacagctttttcgtttcacttgcagacaagcgggtaatgtcgccgatttccggcgcatcctcccgtctcttatacgcccgctcctccattttatcgagtttagacgcgtcagtatgaatgctgatggcaccgacacgtttgtatcctgtatccgattcaccgtctttttccaattgatggattaaatccttatagtaccgcgctccccccttagcaagctggtaccaatcctgattacggcgttgcgagagccatggacagacgatccccgccgccgcatcagtcgcttgtcccggctctttccgatcaatgacagtaacgcgagcgcctgattttgcgagatgataagccgtcgacgcgcccagaatccctgcgccgacgatgatgtacgatttcatatgcaaacaccttttctattataatgtctattcattttaccaaatagaatgctttccttcgaccttttgccctaatgtggaaaaaccgcgaagttcgtccaatctctttactctcctatcgaatatcctgtcactatcaatagagaaaggatgataccatgagcgaaaatcgtcatgaaaatgaagaaaacagacgcgatgcggcagtcgcaaaagtccaaaacagcggtaatgcaaaagtcgtggtcagcgtgaacacagatcaggatcaggcacaggctcagacacaagacggggaagactaatgaacgaaaacatcattcctcttaacagacatactcaagagttacccactactgaatctgttatcaaaaatagcggcaactcagaggtccatatcgacattcacattgatacaatgccaattgcttttgctatattatgctctgcattagccgcaaagcagatgacaaaagaggaattcgatatggcttatactcaattgcgagagatgaacagagaaaataacagcagatcatctgtaaagcaaattatcaatcaggagacagaagaagagtaaaaaaccgcggcccctcggccagcggtttttcttctgcatacaaaaaggacgcgactgaatcggttacttctgtacaatttgaataaggttaccgcatgtatcgtcgaagacagctattgtgacttcgcccatttttgtcggttccatcgtaaacgtcacgcctttttcctttaatcggttgtactctttttgaatatctgcaacgccaaacattgtggccgggaggccttcggagaatatcttcttttgatactccttggcggcaggatgttcattcggttcgagtaaaagctcggttccgtcttgatcatctggagaaacaagcgttatccacctgaatttccccatgggaacgtcttccttttttataaacccaagtttttctgtataaaactccagtgccatgtcttgatcttgtacaaatatactggtaacaacgattttcatactgtttttccctccttcgatatgaatgaagcatggtactatgctaacaatctggctacaagcaaaacaacccacacatttatcagaggccctgttctgattttataaaattattctatccatcctttgagcaaatttttaagtggttcgttgttgaatataagtactcgatattttccctttcgttttgatgttacgagtcctgcatcctccagtacagaaaggtgtttagctatcgcctgtcgcgtaatagaaaggtcgtactttgtaataagacgtatcgtaagttcatacaacgtcagctcgttgcgttcagataattcgtctaatataagccgccgagtcgaatcgccgagtgctttgaatatagcgtctttgttccaattcatatattgagtataagcaactcattagttgcatgtcaagcataagcaactgtatggttgcgcgatatagaaactgaacctatccggcgcagctctgaaatattctaatcgataaggacttaaaaccatcaaaataacagtggatatgtctctgaaaaataaaagaagacgaacttcaaaagttcgtcttctacaatcaaattcggcacgccggccattttaaaaactatatctaaaccccttgataaacaaaggagttttcatcattaaccgatagaaccttccatttcgactctgattacgcgcaagaaaaacacaaacgcgcataaaataagggtttccaccgttttgcgttatcgttttttttagagttttagtggaaaagtttatttttcggtatcaaaagtggtatcacattttatctgtaacacaattaagaaagcttatataataattttaaagggggatgctcatgaacataaacaaaataaggtctgctctttataaatcagctaaagttttaggtgacgtaaatgcagctaagaacggcacactcgggaaacgacttgctcgccgtgccgcaggcaaaacaaccaataaacttatgagaaacttattcaaataaaggagatgagatttttgaagaaagacaaacttgatcctccagttggtacatactatgatcctcctgtcggaatgtcttgtgaataaaatcgggtggtaacgcagatggtcatgacagattttgaacgtaagttataccggatcatcgttaacatgcgtttatatggaaagaacccgactttgccagaactaaaaagaaagaccgggaaaagtgaacaggaaatacgtgagactacaaaaagcttaattcgtaaaggtgctctttcttgggataaagaaaagaaaatatggattatttaaagtccctctctaatgagccgggactttttttgttttatacaacaggaacaaagacacagatcaaacgaatcatttttttctaatacaaagccttttcaattattcctcttttcctcgtggtaaaattttagatgtaaagttccaaaagaagggatatgatcatgaaagtatttgaagccaaaacactgctttccgaagctgaaaaccgtgcaaaagaatacaaagatttaaaaagtaaaatgatcaaattaaagaaagcattcaaagctgtcgctgatttagatgatagtgaattttcaggtaaaggtgcaaataacatcaaatcattttatgaagatcaggccggcattgctgaccagtggattgatctaattgagatgaaaatatcttttttaacgagtattcctggtatcttggaagactccagcttatcagatgcctacatagaagaatccttcctagagcatgagttggccaatgctaattctaaatcaaaatccatcatgtcagaacagaaaaaggccatcaaagacatcttaaatgaaatacacgatgtccttcccttagatgttttttcaacggaagattttaaaactgagttatcttctgctgagaaaaaacgaaaaaatacagtcgagaaaataagtgaagtcgatgaggacctaacgtcagaatacgccttgtcagaagcaaatgaacaaatgattcaggctgattaccaagcactcataaatgcaacagcaaaaggcaagagtgcctctcctatccactataacgcaaaggcttatagagacagtgaaattcacaagatgactgaggatgtaaaaaaacaatcgactgattatatcgcctttaaagatcagcaggccgaacaaagaaggctagcaaaagaacaggaagagctagcgaacaggccatggtacgaaaagacgtgggatgttgtttgtaattttacaggggaagtctctggatattatgattataaaagagccgctgatggagttgatcctgttaccggcgaaaagttgacagagggccaacgtgtagcagctggagcgatggctgcggcaggttatgtcccgattgttggatgggctggaaaattagcaaaaggcggaaaagctgtttattcaaccagtaaagcactctacacagcagacaaagcacttgatgtctacaaaacgccacagacattccatgctcttcaaaattcgagtaaaggtctttatgggcttgcttctgcgaacggttttagcgaagctataacaggccgcgacatgtttggcaataagatttcaaaagaacagcagcataacagtataaatgcagcacttgctgttttcatgccatttggtgcaaaaggtttttccggaaaaacgggccttaaagcttcatcatcaactgaaaccgtaactcaagttacagttagtagaaaaggggcttttaaagaagcgaaaagagatgccggtataccacgtgctcaacaaccagaatcaatcaatcgtgtagaaatgcgtactgctcctcacgaaggcggtcgtgtaattaaagataaaaatggtaaaatcattaggacgagagaatacaccttcactaacaacaaaggcgaaaaaattattatacaagatcatagcgctggacatgaaaaaggtggtcaaggtccgcactttaacgttagaccaattgataatactcgaacaggaaaagtccctggcacaaaagaacattatccttttaataaataatttgaggtgattttatgtggtacaagaatatagaagaaagtcattttttaaatagtttatataacgaggtaccaggattagaaagtgtacgcattgaaggtatttatataaaagaagaaggtagaaaagtaacattgcattttgatatgccattctatgccgagaatccacctaagaaatgggctaatctgggatacaactcaatcgcccttcaagtggacttcttcgatatccattccttagaaatgaaaacttcttcagatacatacagaggaaacattgagataactaaggatgaacaaggcttattagaaataaatgtaacaggtgaaattaatgcaaagataaaagcagacaccggttttattcaatcaattaatggttatattaatgaagctatatgattagcagattaaaacaataaagggcctctctcacattagatggggcctttattacttcaataatgcttcaagtttctctttcgtttcagctctgtaatcccactcattatcaatgtctttacaaatcatagaattaaatcctcatttgctttaaaatgtaaatgttcgttttaaaaagaggaggatcttatgattattcttggtattcttgcaacattagcagcctttgtctttattacagcgttgatttttatcttctttgaaaaaactaggaagataggtattcaaatagctccaataagccttgttttggctttatgtctttttttcattatgggtacgttgaatcgagaatctcacaaattcaaaactgaggatgtcactgctgccacagaaagcactacagatgaaccctcaatagaagaggagccgatgcattctgaagacgacgaagactctgacattcagagtgttgaggataaccaaaaagaatttaattttagccttgaggaatttgtacagacttttaatgatgcagtccaagatattgaaaatgatgaaaaaatcgaatctcctagtctcaatcatattaatagagataacattggagattttaaacatgatgaaaataaagacatttatacaagagaactaaaaactgaaagtgatgactccggcggagtttttactttaacagcttggtttgataacgatcaaaatttcaacggtttaaatttaatgacttctggttcagataatattgaatctgaaattggtctttttaatacatttgcagtttttcatgcgttaggaattgatattggtcatttaaatgacctcttagaaagcgatcaagatatgttggatgtagacgagggagattactttgtgcatctcgctaaaattccagatacagctgtagtagtgaaaatcgaaccgaaataaatgatgcccctctctttggaaaaagagagggtttttttgttacttcaatagtgattcaagtttcgctttagtcttagaaccataaatgccgtcttgagtaagcccgtacatagactggaaccgcttgactgcgtttgctgttttcggtccatacacgccgtcgataccgttattcttcgctcccttgtccgggtagaaataaagagccgccaacgctttttgaatccgccttacgtcatcaccttttcgcatagggttagttactttaaaggttccagaaggcagcgcatatgacgtttttttgctgcttggtttagtgcttgaagtgcttgagcctgtgagctttaacttttggccaactgtgattttattagggtctttaatgttattccagctctgaagatttgccacactcaccccgtgctcttttgcaatttcggaaagagtatcgccttttttgactgtgtaggtatctccggcggttttcttaaccgtttttgtcggcgaagatgcagcaccgctgatccctgctttaaatgaatcccaacggttcagcaacttccgagggcactctttacctgaccaatgcttatgaggcacgacatttgcaaaagaaatcccctgttctttcatcaatttcttgataagccattgagcatttgaaacagctttttcaaaatccccatcgctattttcacagatttcaataccaattgatttacggtttcctgtcccgtttccgtctcctgcatgccagccattttcatttaaaggaaggtgctgataaatctctttatcatccacagtaaagtgccagctggttgctgtttccggatttttaacataccgagcatgactggcagcgtctgcccctttcgcagtattcgaagtattatgaactgtaatataatgaggattcatagggtatgctggtctgtttttatttcctttcggaatgaagtcttggataatgtttaccatgtttcatcgtctcctttttgtttatagaaaaggccgccgggttatccagcagcctgttcatccttttcgtttgtttgttcgttgtcattttcgattacgtgaagccggtccgtgatagcagccggaatcttaacgccgatctgtgcaaggttctccgtaatggaaagcccctcattggcgatataaaaaagaacggttccaaatgtcaggacaccgttaagactgagaattgtatctacgatatttgccacaatgaccaccagaaaactgagcatttttcggacataaccgaaccaagcgcttcggctgcggagctccttaaacttccacgctttcaccacaccggtaaggatgtcaatgatgttcagcaccagcattaaatcaagatatttcacacccccaaacagataaactctcgctaagtccaacgtatcaaagttaatgaacacagtcgtttcctccatttcttgttatcacctccttagaggcaaaataaaaacacctcaatgggtgttggttaacttcctaaatctatgacaaccggctccgtggctggataaataaaacctgttatttcttgatattcttctggcgttaaaatctttatcggtatcatatccctgattgcgtttaaaattaggtttcgtatacgcgcttttgcaatttcgatttcttcataaacagttagtccgcccccatgagcgatctgtgaagatgtatgagcagtcacagctgatttatgttttgaaatggaattggacagtccatttaattcattttcaatgctttccaagtcatcccgctgctgtgcaagatacagtgagtcttttgtagaatcataatcttttattaatctgatcaccatgagatcactctcctttcaagaacaaaaccaaaagcaccctggtaagagtgctcaaatcatcattctaagtttttgcatatatcgcttttgatctttcaatctcttctcttgctccatccgaatgtcttgaatatcttttcggaaattagcaaaagtcagtgtcggttttgcataaggatttaatggtttatattgaatggccaaaaggcggacatcatcttcgtatgtcacgccatatgatgtgtcagccaaaatatgcagtgtatcacccttccagaaatcctcttgtatctttaaaagcttcggctcgtagatgtattcataatctacttctatttccgtctgtggatatggattgacgtattttttcaaagccgccaacatactagactcttttttatatttttcatcccgcaatggttccgcccatctcggcatgccatcaatgaggaatttatcttcgtcaggatgcttgtacaataccggttcaaaaacatactctgtttttttgctgtctgtgctgctgttttctttaattgcaccaaaacccctcgctcttgtggaacacccttgagtagaggttttgattgtgataccaggcatattatatcgagtatcaagtgtatgatttattcgtttgcccattttcttatacacgtagactttataattatcgacatctaattctaagccatagtcttccacaatttcatccatcagatcatttccgaatctgtcaccgaaattctcttgttcaacgctagagaactcactttctttgtccataaagatgtaccttaattttgtgcctttaaaaacaaaatcaagcatcttcctgacggtaaacgtcccactgatcgtatcttccacatagtgattgtttagtgtcacaacgtagacgtggcttgctgttacttttttcgaaagcgtcccttcctggttaatatctatatctgtgatgaaatacttttgatgattgaattttttctcatcaagataaagaatattgtcattcacaagcaggtcgtattctgttccattatctgccgtccttgtgatcgtaaattcaatgtcctttttccctgtcgtatcgtctaataagtccgggtctgctccgatgacttcaatagcttgtgaatcgtcctgactcgccacatgcagctttggaaaatatacatctttaggaaggctctgatttagcgtaatatcttttccgtcatactctttgctcggcaggtctacgatcggatcaggattacttggttcatccggattgtcgggcagcccctcagttgtatcgtatttggttaatttatacgtgaaaataatgctattgagctttgttgcataatttggatcagttgcatatccagcttttacgagggcagctgtggctttttgataatccgtctctccgacaacggccctgtaatgatttttatcccagcttacgccattgagatacaggttagctaaatcatcaattgactctttccaagagggatattttctaaactttgccggaacctgaacattttcaccgttgatgacttcccatgtcatcatagtgacatattgtcccttgtattcgcctttcattccgaataggttgtgtccttttgttgcaagttcacttgttccccatgcactttcaagacagccctgggcaatgattaacgaagcaagaatttgatggtttttataaattctttgagcgtcggcggctatttgtttaataaaatcttctttagccaaaaaaccaccacctcttacaaataataaagtcgagtatcgaattggatggtgaagtcacttgtgttctgaacttcaaactcattccatcctatttcaagactcggcagccggccagatgttttaattggcgtgttattaatgattgtatattgtttgagaaaagaaacctgctgacttttctttagttcctgttcaatcgtaagcttttcatcattagtatgattgatcaatgttacatttttacctgcagcatttaacaggacattgtaatcatggtccattggatttatctgtacgtcaccgggattaaacacggagaaacgtttctgattcttaaaagaatagttcaactggtcattaggcgggatgttcataccaaaagtccgctttgctctagtgaaatactgcttatcttttgttgtaaaagttgattccgccatccctgtaatattagtgaactcaacagagaaatcgttgaaggttttctccttctcttttggaatgctgaaattcccatcacatgtaacgagaaaacggcgattcggccagagatcagaagaaatgtaataaggaaacggcttaaccaatagtgcatatagctgatgccgatacatataaaaattctcatgtatgcgagcattcaaataaatctcaacatttatctttctttccccataagtcacatctcgtggatgttgcggcaaaatctgaccatgccgccgatgtatagtaattgtttcccgattaatattcggagattccggcaaaaagcttaatacttcaaattgggggagtaagctgtcaaggctctgctcccctagtccattattaaagtcaataaacagttttaccatgcaggcttacccccgtttctgtaacgttttttgttatatcggtctgcgctggtttgatccagtcttactccgtctatatacgtgttggtgtcttttaataaaagctgttgcaagagctgaacattttcatttagaaaatcaatctgctttgccatcatgctgatttgcttctcttgattctcgactacacgactcacgtcaacatttacattggtctgtggcgctttgtcagctgcagccattgaagctttttgaagcaacacaagggcttttgaaatcatgccttgttgaagcgatggaagaacgccaagttcgcttcctacacgcgcccataaaccgatgttgcgttcccgatatgctgggtctgttgtaatcgtggtttcatcaaagccacgttcgtttaggatcgcccatttagaaccaccgcgccccggtgaagtccctccttttgcgtatcccacatacgggccaccgcgagccattgacttcaatccagggtgattggatatatccttgtagcgtcttttaatgtaattgattgcagccaaaacgctatctaccggatttaaaatgttattgtgtccgggaaacgcattggatgaaaatgtacttgggatggtctgcatcagcccctgagagggatgtccggcgagaaaatttgagtcagtaaggtttattgcattaggattccctccagactctttcattgcaatggtgattaagccaggaacccatgagaatggtacacctgcaatgccaacagcttctgttacccatttttgaacctgagctgaacctgtcgatcccttatatgattctgctgtgaaaagaccggcatctggaagaatgcttttcaaaaactcactagctccattttttaatgttttaaggattccagttcctaatgagtgcacacctttgcctgacttaaaagggataaaacccttaaacaagttcttaatcattttctcaggaccgttcaggatcatttccatagcccctgatgcaacatctttcgctttatcgacaacgcctttacctgctgaaattgcaccttttacaagcttcttggagccattaacagcgtctttgaagaagtctccgacaccgcctgcataaccgggaagtccggttgccatgacttcttttgactgactatgcgggagaaccgatgtcccacgcggtaaatcccaaatctgcggacctcccattccgactacatacgttccgatgcctggtgtatgagcgagctcatacccttcttcaccgactaatgcccttccgcctgggtggaagtctgtcccttttgcataggccttgcccggcgctattttcatttcagagtttccgctatatcctttaggtttccattcaggaatggtaggaatgtgcatgaactcaagaacagtattgattccgcctgtaattttattgacaacacctgccatatcaataacaaatgtatcaaattctccgagaacttctcctgtctcccaatcaacctgttcaatatgtccataagcttgaagctttgcttcctttactacacctttatgagtatcttctgcttttttaattgtttcttcggattggcttttagcgtccccgacaattttatcgtgctctttctttgaaattataccttttacgtaatattgatcatcagcagcggcaataacagcatcgcgttgcttctcggcatctttaattgttttattttttgccttgttactgttttttacaactgcggctgcctgtttggcggaaaggtttgacgtttcttcttttaactttcttgaaattttggtttgttcatctttgctttgggttagtgctgtctccatttgggcaagcatttccccttggatttttgcaatttctttattctctttttccgtagttttgcggttttctttagcggcgtttcgataaatttcatttactcgatccacataaccttggattttcttttgtttctcctgatttccaacttcaatttcatttagaatcttagctttttccttgtttgacattttatcattagaagcaaaaaattcttttaataccttagtcgctgaatcagcgcttgtttggaatccatttttcaatgaatcccccatcgctgtaaactgtgttgtgacattgtccgctattttcttagtgattttttcgttggttaaacggagatactcaagcttagctgtgactttagtgttcatatcttcgtaagcattcacagcttttgcagtagacttcgatactccctcaccaaaatctattgttgctggaagaacccttttctttaggttgtcatgatacttcataccggcttccgcgagaagcgttacacctgtaacagcaaggccgataggaccgcccagcaggctcaatccaccgcgcaaaagaccgacaattccagcgcccttttttagaatgttaaaaagaccaaacccacttttcgcaagcttcataaaaccgccagcgccttttactgcattcacgccagctttgatgatccctgaaccaaacttgagtagttcgggagcaaaagaaagaattaaaccggcgatcgttccaactggaccgccaaacaaacctaaaccaaggcctgctacacgagaagctccaccaaggcctctcatcgctcttgcgcttctagttgtcgtttgttcaagccgtcctaccctagttgtggcaagcgcagatgtttgatggagtcgatccatccttgtggatgccactgttgccgctgttgaagtggcagtcatgcccgccgctgctgttcttgaagctgcgccggctgcaatcgcatcagcagaataaacagttagactcgtagaagcgcggttgacatttccggttaaataagtcgcagctgtgcgaagcatattccagcctgcagccattttaggaatagaacctaatgccaacaggaaagccccgcccaagagcgagaacacagtgaccgctgcacctgtaatggcaattgtgctcgcgacagaagaaggcaaagaatcaaaccatgtcacagcccttgtaataacgtctgttgtagcacgtatcactgggataaattgatttccaagtgtaataacagcattatttgtggccgactttaaatattcaaatgaaccggctaggttgtccatttgcttgtcagcgattttctcagctgtgccgccgctgttttccaattcttttgtgaagtcttggagtttatcctttccagcgtgcattaaagtaatgaagcctgatagagcatgctgtccggcaagctgtttggcaatcctgatttgttccgtttccgtatagtctttggttttctcgttgatttgccctatgatgtctgctaacggacgcatctttccagttgaatccgttactttaagacccagttcttcgattgccgatgctgctggctttggaggtgcagccaaacgagttaatgtagctcgcaaagctgttccggccatatcagctttaatcccgctgttcgccatgatgccagttgctgcggccaattcttccatgcttacacccgcggtttttgctgcgggagccgcgtatttcatggtttgaccgatctcttgcagggtggcatttgagttggtgaaagtataagccataacgtcagcaacgcggttagtttcctctgcttttatatgaaactccgttaagatgtctgagacaatatcagctgtaacacctaaatcggtttgtccagctgcagcagttgccaataacccaggcattgcgccgatgatttgattggtcttataaccggccatggctaaatactgcattccttcggctacttgaccatctgtgtattgcgttacagctccaagatggcgggcagtttcagtaagcgcggccatttggtcatttgttgcatttgctaacgctccaacccggctcatttccttttcaaagctggctgcagccttaacagttgcccctatgccaagtgctccaaccgccccgatagctgtcaacgccttccctgtttcagtcgctgaattatagacagcctttaattcttctgatacttcttgcgagtcctttttaaagacagagaaaacacctgcagcccgactggtgtttcctgacaatgtatcatattctttgctgacttgttgcagttctcttcctaaattttgatgaacagctattgcgtcatttaatcgccgcgcttggatttgtgtttcgcggttgtcctttcctttttgatgggctaattcatcatatctctgacggtgttcttggactaaacgaccttgaatcttatatttattgcttagtccttccatttgcgactgaaggagtttcgtttggtttccggcatttttataaatattgccggccgccttcatttctgagtttgccaagcgcatttgccttttcaggccttcaatacctcgattaaatcctgtatcgtcaagacccactttaacaaccatatttcctattggttgagccatatgtaaacaccccgctttcctggcataaactcaacaaaaaaagacaggtgcccgcctgcctaaaagatttgatcaattgttaccgtcttaattttcggcttattcttttcagccaaaacctctaagtaatggtaaatgtccatgttatctatttcagtcattttccacccttgttcaagcaacgtcgaataaatttcatttatttgctggattcctctttcgtaggtgaattcttctcctgcaaaaaatcttgatccgcttcctcgatttctttgtatccagctacttctgaaaggatacggctgatttcttttgtcacttcaaatgattgtagcccttcgaagaactcgtcataagtgaattggtcagcgaataatttcacaacaaactgaatttgtttttccaatattttaatgctcttttcaagatcatctgccgttttttccgcttcagcatttaatcttagcgcttcaagtagtgtttttgtatttgttcgcggtgcaataaaagttttaaactttttttcatcttcaaaccacaatttaattgaaatatgtttctgagccataatgactcctcctttttggttaaaaatattttatatgaatagagagaagcttttcagcttccccttttatttaccaagatcaatcgaatttccttctgtgccttggtcattttgatatgcttcaccaaaaactgccttataaaagtgatctatatcgaatttttctccatcttcatccgcaacgattttgaacacatcgtcctgctctctatctacgaattcggctgaaagtttgatcgtttggaaatccgttttatcttgttttgttttccattcatcacccggcaaagagaatctcccttttaccaagcccacatgacgagacttgccgtttgctttaggaccttggaacgtcatagcaacccatggaggaatgatatttttcttaaacaagtacaatccattttcatcttgttcaattccaagtaatttagagagaatttccattggcaggtctcgcatttcaatgtccaatttagttgaaccggttgaaactgcaagatcgacaagtttgtcatccgcatattgtttttctgtggatgtttctgtttcaactttcatattgattgcaaattcatagtcaagaatttctgtaggaacaaaaaatttacccgccttttttaatggcgcgaacttcacattctttaaacctgtcactgaactgtattcaggcatcttaaaacctccaattataataaaatgtttgcttcgaaccgatatccttttcgaataagacgttctttttgtaaaaattcattgataggggccgttgtctgaaaatccaggccgctcattacatccacaataggggcaaaaataggatcacatgaactattgtggtacacatcaatctgataaacggcgctgtcttgtatcggcttcccatcagcccatttagttgtcctgtagtctatctcctgaaccacaatgtaaggaggagaactttcaatcccttctggtacggccagttcataaatatttgcaggatcaatcaataataaaagcgccggatgggtttccagcgcttcaaatatcttgtcttttaattgcattgatctttcgatgaggtttaaaagactcatagcttataccctgcctttatgaccttttccatagcatcaagcatcttatcattcgcctggatcatactgtttcgaataaaaggatttgctgcctgatgaatggttccaaactccggcaagtgaacacggaatttagtgtcctttgtggggccgacaacggcatatatttctccgtcttcatctcgctttatcctgtttccaacaataatgtcctcgtcaatgtgagggtgcttacccccaatagctgaccgcggagcattatcattgattacttccgccaatacagcaccgcctgcttttacggttgctttatggattttttcatcctttcgggctaagtctgcgaaagtagattcgagttctttaaaacctttcaattccaactcaaaattcatcagctcaccacatttgcttttattgtaatgaagtgccggcgagaatagttaggcaagatcgactcgatttcataagctttttcacgaaagatgattcgcatatgctcgtctatgtcttcacgatgacgaattgtaaattccactgtcttttccttctggatcgcagccgcagcataatattctcggccttttaaaccttcagctttagcccagcattcaatcaccgtttcccagctatcctttccatccacaggcaggcggccagcaggcttctttttctgaaattgaatccggtatctcatatcattcaacattaggagcagcctccggtaatgtatatttgagctgattaatcatggtagtcagcacgccatccaggttcgaagtggtgccagcaatttctctattttcataccagtgagcaacgaatgcattcacacacattgccgccctggctgatttattcgggaatgtaagaccggtagccgaagcaatgtattcttttgctgatgcaataaagtctaaaatcaaatcatcctccaggtcaccatcaacccggaggaacttttttgccttttctaattcaactttctcttcttctgtcactcgacatcacctgtctttcattcagcagaagtgttcggtttcagctcatcaatttgtttttgtagcccatctaatacgtttttcacttcactatttaagtgatccatcataacgctgcccgttccaatgttaatgctacggactgatttttcctgcagcatttcatgcgagatggattgttcaccgataacagcaggatcacccttgtcaccctttggaccttggggacctggctcaccttgtggtccagcatctccttttggaccttgaggaccagtatctcctttgtctccctttggtccctgcggaccggtatcccccttaggaccttgaggcccgggttcgccttgcaggccttttacatagagaggattttgttcactgttgtccgcaatagagacatctgtaatcggttcccctgatccgttatctcttgctgatgtttttgctccgttactttcatttagaaaatctgccatattaagtcatcctttcactattgtttttatttccctacatctactgattgatcttctgtgctatcgttaatctgtgtcccgttgtcaggaaccgcatctttaatagatgaaaattctgcgtaaacaactgcatctgtatcccaaagaaccacatcctcgcgttcgataattctcaaatctgtagaattacggtagaatgcttttcccccaacactggtggctaaaatagaatattgttgacgatcaaagagtttaacagcttctttaaggtctccgataattaacggatatttggggctagtttttgtaccaccgtttggcaaatacttatcagaaataatggataccggcttaccgaacagtaattttttagttggatctgtaggattcggttgcaacaggtaacgaccgaaagcatctttcagtttatccaacacattaaaaccagattgattcgttacagctttggttgtagcattaattgccggatcaagcttgacattgagaatgtctttaatgtcgtcctgtttcgatattgtcgttttcgcaagtgaacccaattgttcaagaatcaatgtattgcgggttacagccgattttttagcgagccaattggagagatactgcaaaagcgcctcttgagtatccgcgagcaaatcatttgagagaaccaaaatccctgcatagtctttaatgttgtatttaatgttttcaaatttagggttctctaaatcttcaatattcgctaattcctcaagatttactaaaggtgtgatatctgctaatttttcaagtacccttgatcctttgtttgtagatactggaatgacatcaacaagatttgccagagtatcaaattgccggcgcttttcattgatttttgtggaaatatcttgtggaacaataagtccaccatcctcatctacgccttccttcatagctgcaagtggttgcgggactttacccgttttgagagcagatgcgaaaagctgaacatgattttttacttctttacctgcgatatcatctgttggttgctgtatctttgcctcaggacctttctgttcttgctgctcttcctgttcatacgaaacctgcatatttcggacatcttcatatgtttgaatttgctctttaattaattgggcttcagcaagtaactttttagcatcctccattttcccttcatcggtcagcgcttcaatttccgtgcgtttttctgccaaagcctgtcgtaattcgcgttcctttttagacattccacctccagcaaaaaattgaatatcaaggttcaataactttttctgtttcaattgcttgtcctccttaaaattgggcataaaaaagaactcttagagatttaagagttccagtttcatattgatcttttgttttaataattcatcttgtcctgtatctttagctggactttcagtagcttcagcagcagattgagcaacaatttttcctggtacatgtttgaaatgtgccataacccgatgatcaatgcaggctgctacatcctttgattctgaaaccacatcgatcaatccataatttaatgcttcgtcggcagtgagccacgattcatcatctagtagctggcgtaaagtaccgtcatccaatttgtcacctgctttcgcaagatatgtggaaacgatactttcagtaatcttgtccagatcatcggccgccttccggaattccgctgcattcccgaccatccccatgtatgggttgtgaatcatcatcatggcgttacttggcatcgtaattttatcgccggccattgcaatgacggaagcgatactcccggccaacgcatccacatagacattgattttggctttatgacgctggagcatagaatgaatagcctgtccctcgaagacatccccaccgggggaattgatatacaaatcaatagaattcacttcacctaggctctttaattcagactgaaaagctttagatgaactttcactgaaccatccttcaccggtaattgaaccataaagcgtaatttcagcagctgactcattcagaatcttcatgttccaatacttgtttttcttctgttccgttgccatcaccccctttcagtcgatccgaggattgtttcgtcttgctgagttggtattctttcataattgaaagaggcacaagatttaagttcccgtaatgctcatcacctatctcaccgatacccgtcatgtcttctttttgaagaattgtattcacgctaaaggcgccgacactttgcattgttttataaaattcagcacgggatttactatctccgcggagctctgattccaagttgaatttaaagtaatagccatcattccgctgtttttctgttaaaaccttatcatttaactcttgctcaatatttgtaacaaatggctgcaatgtagttttcacatagtctagtgattgttgttcaatattcgagaaggtagcccgatcaagttcaccaattttatgcggtggcaccttgtaaatagatgcaatctgctggcgattccatttcatcgattcaataaattgagcatccctcatgggcatagtcacttgtgaataatccagcccagcgtctaaaactgcaatagactgtcccgcattcacccgttcccagtcttccctaagtatttgtttactttgtctgtccaaaagggttggagctttgacaacaccgaacggcgctcctccgtttttataaaatttcgcgttaaattttgtggcggctctatttgatccaatattgtcacgaataactgaaataggagtttgtccaacaactccatcaagagacagatttttaaaatgaagcacttcttcataaaaaaactcacggtatctgccatcaagagttgtggaataccagacgcgtccgttgttaggatcgatatttgtatttgtcgcttctggatctaagggtctgattcccgtcacatttccgtctttatcaaaaagtaaaaggttgtagctgttcccccaggtacaaagccgcgtaaccaaaagccgcttccatacaaagcttgtcatatagttattgactttgttcagaatcatttcacttacattgttttgaacctgttgtatattgccgttttgattctgaaaaagcttaatcggcaattttgcaatatcgtcggccaaaacaatcacacaggcataaacatctggatgtagaactgccgtcttacttgaaaccctttcaccagatgcgctttcagtaccagcaaagatatttctaaaccaagtagctggatggagaagagaaccgctatcctcttctgcaatttcattttttattccgcttttcagacggcttaatagcatttactcccctccctcatcactatttttttgctgaattagacctgacagccccgcaagagaaaataaaaaaacaccggtcgtaattaaacccgcgttaatatttatcctatacaaagcaactgcaatgaagaccatgccagcaatgagtaagagatcctctacaattggttttatcattttcactaatttcatactgtattccccctacagactaaaagcaccagactgaatataagcgtttaagtcaactgctctctcaacttgagaagcacgtacatacgcattaattaacgctgctgccgggtcaatccgctgagttgatttggatttatcaagcataatattctcttgggcatcaactttggttacagcgttccccattgcccaagttaacaaatcatttttaggatgaatgatttttttcgatttgactttagctctaaaatcctttgttggttcggataacgtggctacaccctgccgtatctcaaccattgtgtatccatccgcttccatttgctgagcaaactgtgtggcgttatatggatcatagcctatttccttgatacgccagccgttttctttctccatcttcttaatgtaggccctgatatagtcgtaatcaacaacggcaccatcagtggtcgttaaccaatttcttttcttccacaagtcatatggaacgttatcagtcttcattcgttcatggaatgtatcctctggcataaatccatgactttctacagcaaaactgccattatctaacggaaaaataaaagatgctgccgttaaatcaattgtttttgataagtcaatgccgacatagcactctcggtttttcaaatccgggattttatcagaaccgcaatctgtccaggcttgcatatccatatagccgttctctcgcatgttaacccagatattcatgttctttgtcatgaaattccgcattttctccgggacggcaagcgcgacctccaactctccgcgcaaataattcaatccatgctcattggcagcgacaatcgggttagctttaatccagttcttttcgtctttgacgtcatcacctttatcaagctcattgatcatcacaaaatactgttcattttgttccaccttattcgggtccaatatgcgagacacataatcatattcaacacgataagcaggattattcaattcaaatccggccgtagtaataatcaacatcaatggttgggcccgggcagccataccggaagccaggacatcataaatttctgaggttttatgcgcatggtattcgtcgataatgccgcattgcgggttaaaaccatctccagtttttccggcatctttagaaagcgcctcaattttagactgtgttttaggatgttcaatttttccatatgcaatccgatattttttctccggcttgttcaaaaggtcagcttgcataatttgtgccttaatttcgttccagcatatttttgcttgttctgtttttgtggcgccaatgtaaacctcggacatatattcatcattagccattgcctcataggagccgacacaagccagactctgcgttttggtgtttttacggccgacctgccaatagacttttttaaatcggcgatagccggtatccttatgcacccagccgtacacattgccaaagatgaatatttgaataggctctggcacaatattctccccctgcaaaggtcctttcgtgtgtttaaactgggtcatccaataaagaaaccggcgggctttttcatcatcaaacacataaggaaactcccttgtgccttcccgactcacatcatttaaaaaacgctcgcaggcccaaatgtgtttttcacacgccacaatctcacccgatatcacatcgcgcgagtaatcaatgagaaattgtttgattgtcttcatacgtttctaaactccttctccgcagccgtcttttcccgctcttcctgggtacgggtgatagcaagttttgccctggcagacggtgtaaggccaaagtcattcgctgctgatttcatttgatcaaaataattcttttgccgctttaataacggatgctcttcaccaacaagctttattgggttgccgtcttcgtcttttccttccgtatggaccatgatcccgtcttcttcgataattttagaaattgatacatactgcgaataggcattacaataggcagccaacatgctgatgtccgcttccgtgatgatttcaacttctgttaatagagcagcaacccgtttgaattcttttttcccgaccttatctaaccacgttggcggttttatattatcggatcgcattttcattttcttctcgtgctcagcccgggcggccagctcttccgtattctttttatttgggttgccctgtatcaattgaagcgtcgcggattttgcaggcctcggcatgttctcacctcatttcacatcaaaaaaattgcattttttgcttgtttttttcaccaatcgtgatacgatggaattaacaacaaaaccagtcgtaccaagccctctcggcaatttcgccgggagggtattttgtttttccggaaccttgaaaagcggtgtttgtttgcagaagagggggcgccgttctccaaacgtttcctttccagagatttggataggggggagtgtcacttgcccttactgccatgaaccttgttgtgacaggcgttacacaggcttacaaggttgtccaactctaatcttttcgaccaatcttcctttacttccacaatatgatgcaccatgtcagccggagtgaagcaatgatctttcaaacaatgctgacaaagataattgtctcttatcaaagcaagttgtcttgttcgtttccaatctgttgatttataaaaacttgttattgttttgtttcttgaatgtttgttgtaatgttttgtttcttcttgttgctgtgtcttgtgtgcatcacagtaccgaccacgcgtgaggctggggcacccaggggcggcgcatactctcatgggcttaaggggcataaaccttatcctctatttcttcttttgttgaattgatgtaagtttgtccaataacatcatcaatgattgtcgtaatcttttccccaatctttctcatcaatatctccattaaaatcagatgcctccattcttcttccatctatccaaagagtttcttcccctcgtgttatctctgatacatccacatcagcaactgacacatctatgtcgtccccatatacatagaagccttggctaatcgcctggcgtatatcattctctatggatctcttaacctctttgtccacatgtccttttgcccttattaacagcaatttcatgccagttcctccttaaaaataaaaagccttccataccagagacagaaaggcgttaatgatttattctagtattctcttgatcaatcagcggttgcattagtattttgatttgagcattcaccttttcatattcagcaagcaggcgctctgctttttttagtcttttggcttttccatattggtttcttattgttcttatcctcttttgaagcgatctaatatgaggcgtagtcacagagcaaactgttttatgctggcatgatgggcattgaatgaacccaattactacactattttcttttttgtgctcgagtaaaacgatatgatgtttttcgccacattgttcgcatttgctaaaaggtttcatagtgctcctccttccaagtctgaaccatattctttctaaactgccaccgcactcaagccgttaaccgccaagagtctatcctgagatttaccggaagcagtttacagagaatataaaatcaagggggattaagactgtttaaaggttccccttccccctgaaacgttcctttcctccaatgctcatgtgcacctgaacacctttggtggtctgcactactcaaataaaaaagctcatccctaaaataaaacgcccttccgctaagcggaaagacgttaatgattcgattcaattcaatctacaactgagacctcaacagtccctgtactcttttgcaaatccttttagccaatcattttaaatcatcagctaataatttttcatagaattccagcatttgtttttttgctacttctttagttattttattggtttcttcatcagttaattcacgtccaacctgtacttcttgtttaagtcttttccactccgacttcaaaattacattctgtaaatatataagttgcggatggtaatctagcattattttaatatcaaaatcaggaataagactcggttcaatgaatagctgatcacaaatagcactttttatctcggccattttcaaaggcactatttctgttggatttatataaagataggttttagcccaattgtgttctagctctacattcaactcatctaaatagtttaacttctgatctatttcttctgggttctttttcagatacttcaactcagtagcaagcatatatgcagcagtattgaattcattaaatatacccctaacagtttcgatccattgtgctctttctttacttataatttcaatatacctattcttatctaatgcttgtatattttgttttccaatttcatgtgaagttttttctgcagatcttgatgctctataagagataacacctacaattacagaagctattaacgaagcacaagcaaccacataaggtgctacaatccctaacgtcgactcttgatgatttagaatttgagccactttgtcagatacatcaattaaaatatcagtttgattttctttcattgttatcactcctcaccttattatcggtgaaagtaaataacaaaggaacaaattgcagaatttgtcgaaaaaaatttaatacccccttatgctaaatgcttatcaaaattgatctcacacatactccgagaggaagccaagtatagcaagatcgcacaatgaaacacgataatactattctcccgatacggacgcctcagactagctgctatccaggctcagaatgttcctctcgttttggcttcattcctcaacacctttgttccgtatccgaattcgtcttgataagggaaagacgcttctcccgtatatttcgataagttttatttatcgtatttcgttgataggttaagtttatcgagatttcaaacataaatagtccccctttttgtcccctaaaatgtcccctgttttatcgggaatttgtcgataaaaaagcactcagataattccgagtgctgtggcaatacgtaaaatggcacgctgttttatttcataataggtgtccttcttcatgccgagttccatatagatatgaatgtcttttgtttggctggctgataagtattttttttcaatgatcatccgttcttcatcgtccaggctgttttctaacgccctttccatctgtttgaccttcagttcatttaatatgaaagaatctctgatagaaggaaacgggctgatgccagcgtcaaccgattcctttttattctcaagctgtactttcaaagcacgataatctttgagttctttgatcacgatttttcgaactgccttcaaatccacaggatgaaggaatgaaagttgttctgtcacacccgtcctcctttccactatttttcgcgttcccatttttgtattcgtctttccgtgaaccaaacccataagagaagtgcaactgaattaaacatgaagagagcagctaaaatatagatgatcactctgcgccctcaacttttttagtagtcgtaaaataaaacatgctagtaaaatccacattggaatcctttttgcatttctcacaatccatatcgaaattacctgacatataccctacatcgatcaagtcctcatatcccatcaaataatggcagtgagggcattttatgatgtccactgtctctgtctcttttttactcactccgcaccctccaaaagctcaggatcttcgtaaatattgccgatgacttcaaagttgtttgtaaaatctaatggagcaaaaatattttcttctcgtcctttttgatgttttttagtttcgtaagtaaaccaagcacccttaaagtcgactacgcctaattgtgaaaatccttcgattatgtcaaagtcaataatgccgccaccactatcgtgatttggaacatgttcatcctcttcccatacacgaagaatatccccctcataaatctcccgaccgttcttgtccttcaatccggtgtattgcatgatattataaggtctttgatccggagtagatataaataactcgttaaaaggagcgtcccacaaatcttcatgtgtaagcatctttttccaaacgatatcccagacccgaaatttaatttctcgcattctccgttttcctccctccattatttttctttaatccacattccaacgcatacaacatggctttaaacttgctgttctcataaggaccgtatattttatttttcataatcaatacaaactcacgttcggtttcaatgcatgcaaaatcccctaatataaagtttctaactacacccatttatttcaccctcgatagacgctgcacgtctgaaatggtcatttggtgatcagcttcacgtactgcctcggcaaatgtttcaatgccggtatcccgtaaaccatggcgctcgataatctcagagaattcctcaacgtcatgctcacggatgccccagctgtctggatcagtggcagcagcgtatacagtcacccatttactttggtctttcgggtcaggctcttcccattcttctcgagtaaaatggcaaagctcatgatctaccagggcagcgcgctgttcctccggcattgtcttccatgcagccttattaataaacacgaaaagcatgtaatccgtcatatgacgttcgaatgctgtgcattttttcgcctttcctgctcatttgctgttaccttctcggatgtaaaaaccgatgtgttcctttgcatcttttaaatgtgggtgatgtttatcaatcaaactttcggccagctgccgaacctcttgtgattcttcaaaacctacaaatgccatggtcattttcccctttcaatcaatttctttttgaatatttcgtctaattcagttaatgaaagctcatacagctgccgtccgtcaggcgttttaaaatatcccattttaagaagccgcgctttaagctcgtccttttttctttcataataaagggccttcattaattcattcacacaaggcccccctttaacaattctcgggccatgtaatgaaaatgatgatagatatagtttccggttgcgctcgggttaataaaaacggttgagaaattgtaacggacttcaaacgtttttaagctgccaagcaaggactgcggcttatattgtgagcgatattttccgttcagtattttttgatagccttccagatcctccacaagaagagtgaatgggtgtttggatgcacgaatcaattcattttcaaaccgggaacggtccttaatggattgaaccagctcgtctactccgtttttccgttcgatggctgcgttcaaatacatgtcccgggtgatcccgtattcctcgtttttcgggatcatggcagaatagtcgcccgtcttcatccctttgaatttgattgccactttctttttacggagataatcaagaacatgctgattcttctgctccctcgtatccacaataatgatcatgctgtcgagaatatttttcatttcagtatctgaatagttatagtgaataatcgtcatgctttcttccccttaaagtacgacatggccctttcatagatttctaaagagagcttgtccgtttcttcatcctcaaaattcgcaacggagctgttcagatctctccagccattcttccaaaatagaacgagcaatctcgcgactttgattgccgcatcccaatcatgattgaaccagtcgtctatttttggattcatttcttgatctatgcccataaagtaattaatgattttgtcaatggtctgtttgactttatgatcctgcattgagtattcaccttttaaatactggatgagccgttttttataagactgaacaaattccacaagttctggatatacattctccggattctcaatataaaggccatccccgtccagtaccaaaggtgattccaaaaaggcaaggtcatcacaaatttgttttgggtgcattttcctcacctttgacaaagagcttatttcctttacctcttttgaattcataaccataggtagctacaacattataaaaatttcttttgcctagtaataagcttttgacccacttttcatattcttgataaagttgtttagcctcaatctgttgtttggaaattttagaggaatactttttcaaaaatgttgatattaatgattgttcatcattttcattccgaacacttagttgtttttctaagtcttcaatgactttgttcaacctatcaatttctcttttttgattaatatacaatttatttttttctgttaaggtcagttcatctattttcaatatcatactcattattaagactcctttcatccgtccccgcacaaatttccaaacattaggggttactgagttatcatgggttgtcggttttgacattaaagccctataagtaattaatatatatatatttatttttttattttattttttcagtagactaaacagacagattcgacaacccctagtaaccccccataaatgtaaaacatcaataaatccttatatatcaatagttaaagcttctttctattgattgaagtaaccttatccgggttaccttttgaagtgatttcagtaaccccttcagtaaccctcccatcattatttttcaaaaaacttcctccggcgtactgatttaatgttattccatggataaatgtcttgttttttgccccttttgcttttttaaaacctcgaatttctaattgacgataaaaggcacggttttttaactcaacgtcatcattttcataacaccaatccttatactctttgtagagctccttggcttcaatctttacagctgaatgaataacacacctttcatccagaaacggtccaagaatgtccatatcatcccgatatccttccgtcgccttcctgatcgcttcaggttctcccagaccttccttctgccacttcaaacagccttcaacggcccagcgaaggatcccaggcatttccgcagccagtttctgcggcagtttcttgtctactttttcttttgggatcgtgacagtaaacggaatcaaccggatccggcgccaaataccctcatcgctgcctttaacgatcggtttatggtttgtggtaaagaagactttaaattccggcgtaaactcaaaatactcctgtcgcaggaaacgtgctgacatcttttcaccgccggtgatctgcttcaccaacgattcagacagctgctgcccttcttcactctcaacggccgacacaaaccgggcgccgtccagccgggcaatatcattgtttatggcactgtcatttttcttctttatgaaggtgtcgctgttggtctggcggccataatccccaaacaagtgctgaacggtattgataaaagttgatttaccattccggccattcccgaatagaaaaaacatgacttgctccgtggtatccccggtcagtgaatagccaattgccttttgcatgaaatcaataatttcataatttggcgcgccctggtcatctataaaaatgctttccaaaaaagctttccagttcgggcagtcagcgtccggttgatacgagataggggatattttcgtaaaaagcagatcccgatcatgtggcagaagttctcctgttttcagatcgataataccgttatcgcaattaaaaagataattgtgggaatccagttcctgcttcctcactgaaaccattggccgcacatctaaaattgtgttcatcctgatgttgcgacgctcgcacttcttcgcccaatcgttcagctgcttttttcggaatttgtcttccgtggcttttgcttctccatacaacgcccgtaatgttttggcggtgatagcttcaatttttcgtttgctgtcttcttcccatctcttcccgttccagatcagccagtcaagctcgttacaatatcgaatattttttccgtggtagtagacaatccgttcagcattgccgagctccgtcaaatgaaaaaccggcggggtgtcaatgatctcttccgtatcctcaacttgagaattatcgggatgggaaatatacacttcatacggctgttcctgctgctcttccatcaaatcagaaattgtcgtatgggtagaataaacggctgcagcaatggtcatttctccatatgtagagccgtcagatgaatgctgtcgatcccatttctcccgaaacaaccctgactcccgaaacatcgaatccatttttgtgggatccttatccgtccagaatgccaggtgattacataaagccatatctgtggcggagtgatcatcatttatcagatgaccgttaaacagatcctgaatgctcttcccgtttttgctgttgaacatcctttcccatatctccttattagagagattgctcatatcacgggatgaagcaacaggcgggttggacggtttcgattcttctcttttgtccttcaaatatttatcgaacagctctttgagctcgtctgttcgttcttcgacgggcccgatccctaggctgttaccggtaaaggtaaagtatcggccgtggcggtatacttccagcccaagttcaggatttttcctacctgtacccggcccgcgcaatgggatcttaccttttgtgataatatggacgccctcaccactcggagagtattcagtatagctgctgatcgtctggatgatttcctgagcgaaaggagatagaacaccgtcatttacacagtgatctatatctattccgatgaacggatcatctttagaaaacatgaagccgatgccgtcatactcctgttcattgaaaaacttcatgatagtggcaaaggtggaccaggttcgcttattgcttgattgagccatgctgccgtcaatctgatatggcactttcgtttttttgccgttacgctcttccgaacgccatagaatccactgaggggcgttttttagctcttgcggtatatttttaaagtcgtacatgtattaactcccctttaaaaacgagggagctatacactccctcaaatgtatttcttgtgatcaaaatggtacatcttcatcgctcactgtaattgagccggtatcgggcgccggcgcttctgacggcttaaacgctttgacttctggatattttttgccgttatgctctctttctccgacaactaggcggatcggtttattgaggaaagcattggcccattcaatatgatccttaaatttcattccgttcgggaagcccgcggcctttgatgcttgatgaaatctccacattgcattatctgtaacagtgaaattgtcgtataggattttctggccctggcatgcctgttcaacgtcagaacggatttcataatctacgacaagtcgcttatttccggatgaagctgctgttttctcctcaaaattaataaccgttgcctcatattctcctggtttaattggttcaaaagcttcgcctttgctgtggtctactgtgaacatatttaattcctccaatttttgtttatttgccgtttagtacagctacaagattttgagtaattgaatccactacatgcggatcggtgatgtcttcatttcgcaagtcataaattacactgtctatgccactattcaatctatcaatctctgaaattaaccagggcacatcagatatagtcgcttgcccccgaatctcttcgagctttgaatcatttttcacctggctcacctcccaaaacgctgtttaatctatcaatagcagcattagcaagtttgatattccattgttcaagcttctgattcgctttgatctggaactcctcaatcatttgcgcagccttttcattgctctcaatcatcattttgatgtgagtaatcaacccgatgcgttctgtttcttcctccgcctttacgtcaataccgagctcaagccactgataaagtttgcggccgacttccgggtttagcttgattgaagagccttcaaacattcgcgtattgtcttttgaggtctcagctatatgatcaatgtcaatattaaagttgagcataaactcgtattccatttcatctttctgtacaggttttgtcccaaccttacgaggagccattttgccgttattatcaggctccactacatactccgtttttgttctcaatgtcgctaagatgtgaacgtcattttgcgttaacgtcttaatgagcttggttgtttccggtgcaagcttgccccagttttgaaaagagttaccggacatgctgccatgtgtttcaactattccgccttcaccctgccagttatgtgagagtgaatcaattacgacaacttcggctccggcgttcttaattgcttcgactgccatttgatatcgttctgtcgtatacggcggtgtaaaatcaatatgcttaaagctaccgatgcgaatttcatcaaactgtaaattagcgtacagttttgcacgtcggtgctctgtatcaactacgccgatctttgaccagatttcctcgtcgcttgcttctggatatgcttcacgcatcattccgtaagctaccagtagggcaccggctgttttaccagaaccactcggaccgataaagccgacaattgccttttctttttcacgttgtgcgtttgtgacttgaaacatctatcacacctccactttgaaactgactgtttctggctgcacttctacgccagggacagtttgtccatttgaatcaattacgatcggtttaccttcaagctcagtgacagtcaatgtcttcttaagatcaccccatgccacagactcttttataaactcttccataccggcatccttcacatgctgcagaagtttttccttgtccacttctttcggcgctgctttagttgtccggcttttagatttcccataaggtgtggaaagtgtttttgccttaggatcatcctgcagctgctttgtatgataaacactaaccaagttttcaaagaatgaaagactgtccgctaaaggcttaagctcctgcctttcccattcttcaatacgttgcttttctgtggctgccaacgctttgatttccttttcctgcgacttaagtgcagctattttccggaaagcccagttcaggctgttcatatcagtgatttcaaactgtggacggtcccccggcagttcgccgttgttaatttcatttaattcaaaatcctgcaatggattcatatcagacaccttcctctatttgattttgttgagaattccatttaaaatggagttgcttgtttgtttttagtccacatagccgtgtgggcttttttattggtcttcttcatcggtatcctcttcccgaccccgttcatactgcagatactcttttgggtaaccataacggttaatttctgttatgattggatgctcaagattcatatacaggcctctttacgattgagacattaagacctttgcttagaaattgacttgcaatttcatgtagctgaacgacttgttcaggatgatgcatctgtttgatttccttgaacacttcagcagctgacaaacagagatcaatacattcatcgaaattgttgtcctctatttcatctggaagcaattcgttcagcagaaactgtgcggatgccaatttacgtttagctttttccttatctgatttaagaaaatgatttaagttcatgtttgagctcctttctttttagaaagaaaataccgttaggatttgacccgtattttcttctaaaagtttgattcccttttcgctgaatctcatgtcgagacatcaaaggtgtggtagccgcggtatatggatcccaacctttattagtcacccggttttgtagatttgtataactgacaccgttcgattcagctaacttgacaagatcttctgagaatttacggcgcttggttcttggggagagttcacacattcttttcatatgttcgttttgatctatttttggtgttgtagccgccttttcgctatcccatcccatcttcactcttccatagaagacagatctcgagacgccattttcttcagcaaactttccccatttactccattccactctgaatttatcccggtcttggaactgaaccggttcggttaatgctcgctgtttgctccaacctttcctacgtattcgccagatgagtgtgtccttacatatcccgtttgcctcagcttgtgcaaactcttctggtgtaatatagaaatcatatgggtgaaacattatcgatcctccttttttggtataatgttcctatcaaaaataataggagtgtatttcattgcagatctcaacaatactttcaatagttgctgtagctatttctttatttacgctgggtgtccatttactcaagtatctcaatacctttccaaaacttgagattactgttttagacacttttctttttcaagttataaaaggtgaagatcattatggaaaaccatataggatgataatcgaactcaatctagtaaataaaagtgaacagcctatatctatctatgaatatcaatttgtctcaaaagaaattgataaacctgtcttttatagaggacaccatagaccaggcgaaaaatacactatttctaaaattggtgatgaagatacatcaatcaatctaaaacagtttaaaaatctaaaaccacctgtgaatttgagtccctactcatctgaacatggaacaattcttttcttaacgattccaaatatcaataaaactgcaaaagaaattgatggagtactcacagtgagaacatcaagaaaagactattccgttcctgtaaaagcaagaagaagtgattttataaaagggacagaattaatgcagtaagagacagaatgacacaaatactactgactataattccaattaaatgaaatcttctgctatccatttgatcacctccaacctcttcaacctctgttgccgcaggggttgatttattttgtttggtcatttttctctctccttgatttttagatatgtgtcttcacaaatgcctgataaatcttcataaaacgttccgcctcacttaatgcaagccattcttttgttttgatcttcatttttctcaccttcctcatttagtagggcttaatgccttggctgttcagccaaccaggttaacaagaactttttcatttcctcagcaggaaatctccagcgagagccaactttatatttgggacaacgaggatcgtaaaagaatttatctaaaatctcagtccaactcatatctgtcttttcttgaagcgtttttgtattccaaaaaaccttttcattttcgatggcctttaattgctcctcaattttttctagacaaatgcgtttaacttcattttcatcaatctgaaccgttagcattgctattatgaaacctccttcatatcaaggattttgacaattttctctctgatttttttgccctttcttttaccaagcaaaatgtcagagagatacgcattcgaaatgtttagcatctttgctaaatccttttgctgcatgtcgttaagaattaaccaagtcttaacctgctttccaaaatccagttccatagaaaatacctcctttttatatttttagctaaatattcagcttaatattgacagttattaaagaatattgtagagtataggcatagctaaacaaaccctacaaaaactgcctaaaacgttgggggacgtagacataggctttgatttgtggtgtctgaaaaagctgaataagtagcttatgaacatagtgtattaaagatttctttaaaagtcaattattttttagagatttctttaaccagtttttcatgagccattaaggatggttgatatgactacgtttgaaagagttaaaaaactttgtaaagatcgaggtataagcctttcaaggctagaagaaaatgtaggcttcggaaaaaattctatttattcatggaaacaaaataatccttcaagtgacaaactcaaaaaagttgccgattacttcaacgtttctgttgactaccttctcggcagaacagaaaaagaaaactttgagcctgaacttactgctaaagatgaaagagatattcagaaagagctacaaaaaattatagaagggttagaaggcaagaacgggtatgctgcatttgacggccaaactcttgacgatatggacgacgaagatagagagctgttaattgcaagcttggaaaactccctacgccttgccaaaagaatttcaaaacaaaagttcactcctaaaaaatatcgtaagtaggtgcctttttgtggagtcaattactaaaaagatcaaattattaacagagaaatttcaaacaaacaatccgtttaaaattgcaaaaggtttaggtatcgaggtagtttatgaagatttaggaaaagctttggggtactacagtaggcatttcagagttaaagtcatccacattaatcagaatacgaatgaacatagtaaggagtttatttgcgcccatgaattaggtcatgcaatctttcatgcagacgcaaacactccttttttaaaaaggcagactctattttcaacagatcgaatcgagttggaagcgaattttttcgcggtaaatttattgttctcctccaccgatgcgtgcgtaactgtggaagaagctattaagcagtatggaatccctaaacagttagttatatctaacatcgctaaaaatttttaacccaaagaccgaacatatattccgataatgaggtgagaaaagatggccagttttagaaagcacactaacggatcatgggaatatcgcataagaataaaagaccccatttccaaaaaattcaaagagaaatcgaaacgcggattcccaacaaaaaaagctgctcaacttgcagcagccaaagtagagcaggaaattagtaacagcacgtttattccaaataattcagccacattcaaacaggtctttgataattggtgggcttctcactccaagacattaaaaccaagtactcagtactctctagaatcaaaatttaacaaacacatacttcctagattcgcccatttaaaaattcaagacatttcaaaagaatattgtcaaaaaatgattgatgaaattgcggaacaaattgattctgttaatgatgtgaaaatacaagcgaaccaagtttttaaatatgccgtacgtatggattacatagccaaaaatcctatggaacatgtaataattccgaagaatgaggccgattttttggtggaagaacctaaaaggaatttttggaccaagcaagagatcaaaaacttttttaacttagcaagaataaccttagatcatcaggattatgtaatgtttcatttgttaatctatacagggatgagaaaaggagagcttttatcattagagtgggaggacatagattttgacgaatgcactatatttatttctaaaacattgttttttaaagatggcaaggaaataattcaaaaagttaagacctatcaagccaggactatacatattgacacgaagaccatccaaatattaaaaaaatggcgcatacagcaacgagaaactaccccagagggtaaaagatacccctccatcaaaaacgtgcttacacgggaagataaacgccctttacggcttgcatatcctaacgataagtttgacagctttattaaaacccataatttgcaccccatcacaatccatgggctcaggcacactcatgcttctatattatttgaagctggtgcgacagttaaagaagtacaagcacgcctggggcatcgtgatattaaaactacaatggatatctacacccacgtaaccagaacagttaaggaaagaaccgcagatctttttcattcttacattgacttatcataaatgtgggtgttttgtgggtgtgctaggttttcaaacaacaaaaaagacccccaagacaaggtcttgagagtctttgaaacgttgatatattaacgttttgagaactgaggtgcacgacgagcgcctttaagaccgtattttttacgttctttcatacgagcgtcacgagtcagaagacctgcacgtttaagcgttgtacggtattctggatctgcttcaagcaaagcacgagcgataccgtgacggattgctccagcttgaccagataagccgcctccatgtacgtttactaaaacatcataagtgccagctgtttcagtcaaagttaatggttgtttgatatcttcgattaaagctgcagatggaatatgttcgctgatttcacgattattaacgacgatacggccttctcctggaactaaacgcacacgcgctacagagcttttacgacggccagtaccgtaatattgaacctgtgccaaattggtaacctcctttttaattaaccgcgaagttcgtaaacttcaggtttttgtgcttcgtgtggatgctcagaaccacggtatacgttcaattttttgaacatttgacgacctagagaaccttttggaagcatgcctttgatagcaagctcaagcattttctcagggtagtttgtacgcatttcaagagcagttcttgattttaatccgcctggatgttgagtatgacggtagtagattttgtcagttaactttttaccagttaactcgattttttcagcgttgatgatgatcacatgatctccagtatcaacgtgtggtgtgtaagttggtttgtgttttccgcgaaggatagctgcaacttctgaagaaagacgacctaaagtcttgccagcagcatcaacaactaaccacttgcgttcaatagtacttgcgttagccataggtgttgtacgcattgaatttccctcctaaatgatctgtcattttcaataaacttcgattacgttctatttcacaacacaataagttccggggcttatcgtggggttgaaatacataccatatgatatcttataactttatgcagactctgtcaagaaaatattatacacctggtttagttgtcatagtaaacgttccataaatatagcccgtgccccggcgctgtgcgccctgccgcttcgcgatccttcgcttccagcatggatttcacgtcatcgggagaaatttttccaatacctgcatcaagcaaagtacccgcaataattctgaccatattatataagaaaccgctgcctgtgatccgcatttgcaggccgtcagccgtctcagtccaatcaagttcgtatatcgttcttaccttgtcctgcacttctgttttagccgcgcaaaagctcgtaaaatcatgtgtccctataagatgctttgccgcttctctcatgtcctgcacattaaggcgatatgaaaaatggtaagcgtaatgccgtttaaatacgtccgggtgtttctccgtgtatacaaagtagcgatattcttttttgactgcgctaaatcgtgcatggaacccatcatccgcaatttctgcctgtttgactgcgatatcgtccggaagcagtgcatttaaggcatatggccatctctcagccgggatagacagtggagtgtcaaaatgaatcacctgtccggctgcgtgaaccccgctgtctgttcttccagacgaaacgaccggaattctgtcttttgacttatgcaggacagccaaagccttctccagttcatcctgaaccgttcttttgcccggctgaacctgataaccgttaaacaaatgtccgtcataagaaatcgtgcatttcagtctcatacagcacctctaagcccttaagaaaaataacaaagcagctaatacaattaagctgacaatgacagaagtgtcttttcctgtccatacaagctttctatatttcgtacgtccttctccgccttgatagcctcttgcttccattgccaccgcaagctcttcggcgcgtttaaatgcgctgacgaagagcgggacaagaagcgggacaatagccttcactctttctttgacaggcccgcttgtaaaatcaacgcctcgcgccatctgagccttcatgatcttatctgtctcctccatcagtgtcggaataaaccgtaaagaaattgacatcataagagccagctcatgaacaggaagctttaattttttcaatgggttcagcagctgctccattccatcggtaatctcaatcggtgtagtcgtaagcgttaataaagttgtgattaaaatcaaatagacgaatctaagagaaatgaatatcccctgaaccagaccgccctcatagactttgaaaaaacctatttgaaagataatcggtccttcatgtgtcataaggatgtgaagaaggaacgtaaaaaggacaatccagatgattggcttcagccctttcattaaaaaagagaaagggactcttgttaaagaaacgacgccaattgtaaataaaccaagcaacgcatatgtctgaacattattggctaagaatacgatgcagacaaataaaaagatcgtgatcagttttgttctggggtcaagccggtgcacaagtgaagtacccggtacatacttgccgataatcatgctgtccatcataaagtcttctccccctgaaaaagagcgtggatttcagcagcggcatcttcaattgtgagcataggctcattaaatctcacacccagtacagcttcaaggtgtctttggaattttattgtttcaggaagatccagcccccagccggccatctcttcaccctttaaaaacagatcacgcggactgcctgatgcttgtatcgttcctttatgcataacaatcatttcatcagcgtatgcagctgcatcctccatgctgtgtgtcacaaggatcgtcgtcaggttcccacgttgatgaagctcataaaacatgtccataatctcttttcgccctcttgggtccaatcctgcagtcggttcatccagaacaagcacttcagggtccattgcaagtacgccggcaattgcaactctgcgcatttgtcccccgcttaattcaaagggtgacctgtccaaaagctcttctgataaacctacaagttgcagcatctctctcgctttttgttcagcatcttcttttttaacaccaaagttcatcggtccgaatgaaatatctttaagaactgtttcttcgaataattgatgctcaggaaattggaaaacgattccgacttttttacgaagttttttcagatctttattctttttccctgcctgaatgacagtgctgcctagtgatatctgtcccttcgtcggcttcaggagaccatttaggtgctgaagaagagtggacttgccagagcctgtatgtccgataacggctacgtagcttccttctttaatcgatgcattgatatcatacagtgctaggcgctcaaacggcgtcttcatctgataacgatgctctacatctttgattgtaatgtccacagctctttcaccagcccttcctgagtcaaatggttttcttccaaagccagtccattttctcttaaaagctggctaagctggaatgagaagggtaaatcaagcccgattcgaacaagttctttattcaatttaaaaatctcttcgggcggcccttcagcatattttttaccgccattcatgacaatgatcctgtctgcttttgctgcctcattcagatcatgtgtaatggatatgacagtcgccatgccctgctcttttaaatgtcttaccgtttcaagcacttcttctcgcccgatcggatcaagcatggatgttgcttcatctaagataataatatcaggacgtgcggcaataacccccgcaatcgcaactctctgcttttggcctccggagagatggtgcggctcttgatcgagaaaatcttgcatattcacctgttttactgcccagtctactctctcaatcatttcttcccgcggtacaccattgttttctaaaccaaaagccacatcatcgcgaacagtcgttccgacaaattggttatccggattttgaaagaccatacctatcttcttacgcacttcccaaacagattcctctgtcaattgaatcccggcaacctcaatgtcgcctgattcaggaagaattaaaccattcaatgcccgggccagtgttgatttccctgaaccgttatgacctactattgcaagccattcaccctcatacacctgcagggagacgccgtctagtgctcgtctttctgcgtccttccgatatcgaaatacgatatcctctaccgatatcaactgattttgattcatggaaaaccggcctcctctcagctaatgctctgcttttctctctattaaaagttgcagtatctaaaaaaagggcatagatccagttagaaactgtcccgcccttctttagatacacaaaaatatgtgattaaaccaattcgataattgccattggtgctccgtcaccacggcgaggaccaagcttcataatacgtgtgtatccgccttggcgctcctcgtaacgagttgcaatgtcagagaataatttttgaagtgcatcttggttattttcttcgtttgcaacctcgttgcggatgtatgcagcagcttgacggcgagcgtgaagatcaccgcgtttgccaagcgtgatcattttttcaactacagagcgaagttctttcgcacgtgtttcagttgtttcgattctttcgttgatgatcaaatcagttgtaagatcacgaagcatagctttacgctgtgcactcgtacgtcctagttttctgtatgacatgtgatgtcccctcctttattggaatgctgtttctgaataataaacacacgaaaatcctagttcacaagggaaactagtcaatcgtctttgcgaagtccgagtccaagttcttctagtttcgctttcacttcttcaagtgatttgcgtcctagatttcgaactttcatcatatcttcttccgtcttgttcgcaagctcttgaaccgtgttaatacccgcacgctttaagcagttgtaagaacgaacagaaagatccaattcttcaattgtcatttcaagaactttctctttttgatcttcttctttttcaaccatgatttcagcatgttgagcttcgtcagttaaaccaacgaatatattaaggtgttcagttaaaatctttgaaccaagcgcaattgcttctttcggtccagtgcttccatcagtccaaacatcaagtgtaagtttatcatagtttgcaacttggcctacacgagtgttctctacctgataagatacacgagaaactggcgtatagatagaatcgatcggaatcacgccgattggctgatcgtctctcttgtttgcgtcagcaggcgtatacccacgtcctctttgagcagtaaggcgaactcggaaactcgcattctcaccaagagtcgcgatatgaagatcaggatttaagatctctacatcactatcgtgtgtaatatcagctgccgttacagttccttcaccctgtacatcaatttctagcgtcttctcttcatcagagtagattttcaatgcaagctttttaatgtgtaagataatcgttgtaacatcttccacaacgccttcaattgtcgagaattcgtgcagtacaccatctatctggattgatgttacagcggcaccagggagtgaggataagaggatacgacgtaaggagttacccagagttgtaccatatccacgctcaagtggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccgttatgaggaacaggagttacgtctctgatagcagtgacttctagtccagcagcttgaagtgcacggattgcagcttcacggcctgaaccaggtcctttaacagtaacctctagagttttaagaccatgttcgattgaacctttagcagctgtttctgcagccatttgcgcagcaaaaggagtagatttacgagaacctctgaatcctaaagctccggcactagaccaagaaatagcattaccatgagtgtcagtgatcgtaacgatcgtgttattgaaagttgaacgaatatgagcaattccagactcaatattctttttcacgcgacgtttacgcgtgttagatttacgagcagcagccattgtttaagaacctcccttacttattttttcttgttagctacagtacgacgcggacctttacgagtacgcgcattgtttttagagttttgtccgcgaacaggtaatcctctgcgatgacggattccgcggtagcttccgatttcgatcagacgtttgatattaagagaaacttcacggcgaaggtcaccttctactttcagtttgtcaataatatcacggattttaccaagttcttcttcagtaagatcgcgcacacgagtatcttctgaaactccagcttcttttaaaacttgctgagccgttgtgcggccaattccgaagatgtatgttaaagaaataacaacacgtttgtcacgtgggatatctacaccagcaatacgagccattctctgggcacctccttataaattatccttgtttttgtttatgctttggattttcacagatcaccattacttttccttttctgcgaataactttacatttttcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacatgagccaaaacagtgtggccattttcaagttcaactttgaacatcgcgtttggcagtgtttcgactatagtaccttccacttcaattacatcgtctttcgccattcaagtgttctcccttcttcaaatcagtaacttgctttctgacaaatttcaaaagaagtttgtcacacgccctgtttcgtttatactgttctgaacttccggagatacgcaatcataaagggttaaatgattgatattctttttcttaggagaatgaaatgtacgcttttctccgtctgctgttagtacattgatgatggttaaaattccaacgacaagcagcaagatgaattcggtcttgccaatgttcacccaagctttctgccctatcaagcttgaaaaacatctgtcttcggaattattttcatcatctagactctcgtcagtatatcaaaacccgtttccgtaatcgcaatcgtatgttcaaaatgagcacactttttcccatctaccgttacaaccgtccagttatcagccaatgttttcacgtagcggctgccagcgttcaccataggttcaatagcgagaaccatgccaggtttaagccgtggtcctttgttgggcggaccgtaatgaggaatttgcgggtcctcatgcaagtcttgaccaacaccatgtccgacatactccctaacaactgaaaactgctcattttcgacatacgtttgtattgcgtgggaaatattcgacaaacgttcacctggttttgcttcctgcaagcctttatataaagactcctctgtcacttccagaagttttttgtcatcatcgctgatgtttcctaccggatatgtccatgcagagtcaccatgataaccatttaatttagcaccgatatcaatactgatgatgtcaccgtccttcagcaccctgctgccaggtatgccgtgaacgagttcttcattaactgatacgcaaatgctcccgcgaaacccattataccccttaaaagatgggattgcaccctgcttcttaataaaacgttcggcaatttgatccaattcttttgtcgagattcctggtttaatgtgcttttttaactcttcatgagttaaagccacgattcgccctgcttcccgcatgataccaagttcacgtggggttttacagataatcatttttttaatcctccaagaagatccttcacatctgcataaacgtcttgaatgtcctgctggccattcacgtttgcaagataacctttctctgaatagaaatcgagtaaaggctgagtttgcttcatgtttacctcaagccgtttagagactgtttcctcattatcatctgcccgttgatagagttcgcctccgtctttatcacaaatacccggcgttttcggcggattaaagactaaatgataggttgtgccgcaaacactgcaaattctgcgtccagtcagacgttccataagagcgtctttgtcgacttcaatgttaatgacataatcaatcggcttgccgtattcctcaagaatttcttcaagagcttcggcttgagcgactgttcgcggaaatccgtccagaagataacctctttcacaatcatctttgccaagtctctcttttacaattccgattgtgacttcgtcaggtacgagctctcccttatcaatataagactttgcttcgagtccgagtggtgtttcttctttcatagcagcacggaacatatctcctgttgagatatgaggaatcccataatcctcaacaattcgttcgccctgtgtgcctttaccggcaccaggaagccccattaagactaagttcattcggatttcccccgtcctctctttattaagagggaatggataaatccatttcctctagtttttcataaatccacggtagtttcgtttcaccaactggctttctagttgtttcattgtctccaaggctaccccgacaacaattaacaaagatgttccgccaatttgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgttttttaaggttatcagccatttgttcagggtttacctgtacaaaagcataaaagtacgtaaaggcaataatcaacgcaacatatatcgccatacccaccggatgcgtattatcaaagttgttttgaatccactttgtcacatcgtttgttccaaagaatgacgcgatcgtccgcggcgttatcaaaaacgcaaccgcaaagattaccggaataacccctgcaggattcactttcaatggaaggtgtgtagactgacctccgccagcaggtgaacgacctgtgcctttagcatattgaatcgcaattttccgtacggcttgctgaatgaaaataactccaacaataactgctaaaatcgcaatcacaagaagtgcgactttcacaatatgaataaacaactgatcgttgctgccgacaaattgagtctcatatatttgcccaattgtttttggaatactagacacaatccccgcgaagataatgatcgatattccgttgcctactccatgagaagtaatttgttccccaagccacattaaaaaggcagttccgccagtgagcactaaagcaatgataagatatgtcgatacaccggatttttcgatcagcataccgtttgccagattgttaaatccatatgacatacctaatgcttggatgaaaccaagcacaatcgtaaagtaccttgtgaactgagctaatttacggcggccaacttcaccttgcttagaccactcggtaaacttcggtacaacatccatctgaagcagctgaatgatgatcgaagccgtgatataaggagtaattcccattgcgaaaatggaaaattggtaaagcgcaccgccgccaaatgtattaaggagatcaaaaacacccatttgagactgcgcctgtaacgcttcagcgttaacgtaaggcacaggaataaacgcacctatgcgaaagacgataagcatgagtaaagtgaatatgattttattcctgatatcactcacacgcataaagttggagattgttttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctctagaagaagttcaggagtgacttccgttccttctgcaaaaccgttcaatttgtctaggttgactacagcgtattccttgcggttgatgttagtgaaaccgcgtttaggaagacgttggaataaaggcatttgtcccccctcgaatccagggcgtacaccgccgccagaacgagcgttttgacctttgtgacctttaccagctgttttaccgttgccagaaccaataccacgacctacgcgattacgcgttttgcgtgaaccttctgaaggttttaattcatgaagtttcattaggacacctccttatccgatcaaatatttttattgttctttaacagaaactaaatgagatactttattaatcataccacggatcgcagcgttgtcttcatgaacaacagtttggtttgttttctttaaaccaagtgttcttacagtaacgcgttggtcttccgggcgaccgattacacttcgtttgagggtaatttctaatttagccattaatgttccctccttatcctaacagttcttctacagattttccacgaagcttcgcaacgtcttcagcacgtttaagttcacttaaaccttgaagtgttgcacgaatcatgttgatcggtgtgttagaacctaaagacttagaaaggatatcagctacaccagctagctcaagtaccgcacgtacagggcctccagcgataactccagtaccttcagaagcaggttttaacaagatgttacctgcaccgaaacgtccgatgatttcgtgtggaattgtagttccaaccattggtacttcaatcaaattctttttcgcatcttcaacagctttgcggatcgcttctggtacttcttgtgctttaccagtaccgaatcctacgtgtccgtttttgtcaccgacaacgactagagctgcgaagcggaaacgacgaccacctttaacaactttcgctacgcggttaaccgtaactaagcgttcttctaactctaatttgcttgggtcaatacgacgcataatcatgtgtccctccttcttttattaaaatttaagtccagcttcacgagcggcatcagccaaagcttttacacgtccatggtataagtatccgccacggtcaaatactacgtcagaaatgcctttttcagcagcgcgttttgcaactaattctccaactttagtagcagcagaagtatctccagtgctttcaacgttcaagtctttatcgagagtagatgcactagcaagtgttacaccatttacatcatcgatgatttgagcgtaaatgtgcttgttagaacggaaaacgttcaggcgcggtctttcagcagtaccggaaagtttagcgcgaacacgagcgtgtcttttaagacgagcagcatttttgctagttttcgtaatcatctaggtcactcctttcttcactttaagcgatcttacttagcagatttaccttctttacggcgaacaacttcaccttcgtagcggattcctttacctttgtaaggctctggagaacgtacagcgcggatgttagcagcaatagctcctacacgttctttgtctgtaccttttacaactacttttgtttgagaaggaacttcgatttcgatgccttcttcaggaacgatctcaacaggatgagagtatccaacgtttaaaacaagtttatttccggatttagaagcacggtaaccgacaccgactaattccaaacctctttcaaatcctttagatacaccttcaaccatgttgccaagcagactgcgagtcgtaccatgcagggcacggtgctctttttgatcagaaggacgagcgactgtaagcacattgtcctctactttaatctccatatcagggtgaaacgtacgagttaattctccttttggtcctttcacagctacagtgttgttatcatttaacgttactgtaacatcagaaggaatctcaagtagcttcttacctacacgagacataccaaacacctccattcatgttaaacttcttaccaaacgtatgctagaacttctccaccagcttgttttgcacgggcttctttgtccgttaaaacaccttgtgatgtagaaataatcgcgattccaagaccgttaagtacgcgaggtacttcattagatttagcataaacacgcaaaccaggcttgctgattcttttaagaccagtgataacgcgctcgttgttttgtccgtatttcaagaaaacgcggatgataccttgtttgctgtcttctacgaactcaacgtcacgaatgaaaccttcacgctttaaaatttcagcaatttctcttttcaatttagaagcaggaatttcaagcttctcatgacgtaccatgtttgcattgcgaatacgagttagcatatctgcaattggatctgtcataaccattatataattacctccttccctttcttggggattaccagctggcttttttcacgccaggaatttgtcctttatatgcaagctcacggaaacaaatacggcaaagtttaaatttacgaatgactgaatgcggacgtccgcagcgttcacagcgtgtgtactcttgtactttaaactttggtgtacgttgttgtttcgcaatcatagactttttagccacgatttcgcctccctttcattgattatttctggaacggcatacctacttgagttaatagctcacgagcttcttcgtcagtattagcagttgttacgataacgatgtccattccgcgaacctttgttactttatcgtagtcaatttcagggaagattaactgttctttgataccaagtgtgtagttaccgcgaccgtcgaaagattttttagaaaccccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgctttggcgttttgaacagcgtcaccaacacccatgttgattacgattttttcgattttaggcacttgcatgactgaatcatagttgaacttagtcattaaagcaggtgcaatttctttattgtacttttctttaaggcggttcatgagatagacctcccttccttttaatactatttatctagaacttgcccagatttttttgctacacgaacttttttgccatcttccactttgtatcctacgcgagtcacttcacctgttttaggatcgagcggcataacgtttgatacatgaattggcgcctcttgattagaaataccgccttgagggttagcttgagttggtttagagtgtttctttaccatgttaacaccttcaactaaaacgcggtcctttttagggaaagcagcaaggattgttccttgtttgcctttatctttaccagagataaccataactttatcgcctttttttacatgcatcctgatcgcacctccttgagtaaggcatttatttcattagataacttctggagctagagaaacaattttcataaagttgttttcacgcaattcacgagcaactggtccgaagatacgagttccgcgtgggctcttgtcgtcacggatgataacacatgcattctcatcgaagctgatgtatgaaccgtcacttctgcgcgctccgcttttagtgcgaacgataacagcttttacgacttcaccttttttgacaacgcctcctggtgttgcttgtttaaccgtgcaaacaattacatcaccaatgttagctgttttacgtccagaaccaccaagaactttaatagtaagtacttcacgtgcgccagagttgtcagctacttttaaacgagtctcttgttgaatcattatttgttacctcccttcggaaaaagaattccgaactttattagataataacagcttcttcgacaacttcaactagacggaaacgcttagttgcagacaatggacgagtttccatgatcttaacgatgtcaccgattttagcttgattattttcatcatgtgctttgaatttttttgagtattttacgcgtttaccgtaaagtgtatgttttttgtatgtctcaacaacaacagtaatggttttatccattttgtcagaaacaacacggccttggtaaactttgcgttggttacgttcgctcatgctcacgacctcccctcagtgattatttattagcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaaggcgaagcgcttcacgagcaacctcttcagacacaccagaaatttcaaataaaactttgcccggttttacaacagctacccaaccttctggagcccctttaccggatcccatacgtacctcaagtggtttagcagtgtaaggtttagaagggaaaattttgatccaaactttaccgccacgtttcatgtaacgagtcatcgcaatacgtgcagcttcgatttgacggttagtaatccaagaagcttcaagagcttggataccgaattctccgaaatgtacttcagtaccgcctttcgcacggccacgcatttttccgcgatgctctctgcgatatttaacgcgttttggtaataacatattattttcctccttcctcagttttcttcttagtaggaagaacctctccacgatagatccagacttttacaccaagcttaccgtaagtagtatcagcttcagatgttgcatagtcaatgtccgcacgtaatgtgtgcaatggaacagttccttcactgtagtattcagaacgagcgatatctgcaccgccaagacgaccagaaaccattgttttcacaccttgtgctccagcacgcatagtacgttggatttgttgtttctgcgcacggcggaaagaaacacggttttctaattgacgagcgatgttgtcagcaactagctgtgcatcaagatctgctcttttgatttcaagaatgttaatgtgtacacgcttgccagtaaggctgttaagggctttgcgaagtgcttcgacttcagaaccgcctttaccgataaccataccaggcttagctgtgtggatcgtaatgttaacgcggtttgctgcacgctcgatttctactttagaaacagaagcgtcagaaaggcgtttgctaatgtattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgtgggcggaatctttttaacgtagggccttcgtcaacgaatgcttgagaaataaccaggttgttagcgtccatttcatagttatgctcagcatttgcaatagcggattttaatactttctcgataattggagaagcagctcttggtgtaaggttcaagattgatactgcctcacctacttgcttgcctcgaatcaggtccattactagacgtgctttacgaggagcaatacggactgttcttgcaacagctttagcttgcatttaaaagcctcctctcttagcgtcttgtttttttgtcatcactagcatgacctttgtacgtacgagttggagcgaattcacccaacttgtgccctaccatatcttcagagatgaatacaggcacgtgtttacgtccgtcatagactgcgattgtgtgaccaataaactgtgggaaaatagttgaacgacgagaccaagtttttacgacttgtttcttgtctgtttcatttaatttctcgattttagtcatcaagtgtccatcgacaaatggtcctttttttaagctgcgagccattttggaacctcccttcgtgattgcactacggtccgaaaagaaccgtagacaaccccgttatttatttttacgacgacgtacgataaatttatcggatttgttctttttcttacgagtcttgaatccaagagttggtttgccccatggagacattggtgatttacgtccgattggcgcacgtccttcaccaccaccgtgtgggtgatcgttagggttcattacagaaccacgaactgtaggacggatgcctttccagcgagaacgtccagctttaccaatgttgataagttcgtgctgttcgttacctacttgaccgatagaagcacggcaagcagaaaggatcatgcgaacttcaccagagttaagacgtacaagaacgtatttaccttctttaccaagaacctgagcagatgtaccagctgaacgtacaagctgtccgcctttaccaggttttaattcaatgttatgcacaactgtaccaacagggatgttgataagtggaagtgcattacctactttaatgtcagcttcaggacctgacatgatttcagtacctacttgaattcctttaggagcaagaatgtaacgtttttctccgtctgcatagttgattagagcgatgttagctgaacggtttggatcgtattcaactgtagcaacgcgtccaggtataccatctttatcgcgtttgaagtcgataacacggtattggcgtttatgtccgccaccttggtgacgtacagtcaatttaccttggttgttacgtccgccttttttgtgaaggggagcaagcaaggatttttccggcttgtcagtcgtgatttcagcaaaatctgaagttgtcatgccacgacgtccattagaggtcggtttatactttttaatcgccattttgaatttccctccttctttttacagataattaagcttcaaaaatttcgatttctttgctgtctgcagtaagttttacgatcgcttttctgcgacggctagtcataccagtgtagcgtccaacacgttttgatttacctttgtagttcatgatgttgactttgtcaactttcactccaaagatgctttcaaccgcgtctttcacttctgttttgttagctcttacatcaacttcaaaagtatatttcttttcagtcattaaatcagcagaacgttcagtaatgacggggcgctttagaacatcacgaggatctttcattatgcaagcacctcctctactttttcaaccgctgcttttgtaatcagaagcttctcgtggttgacaacgtctaaaacgttgattccgttagcttcaacaacagtaactccaggaatgttacgagcagataaagctactgcttcgtttgcatccgcagttacgattaaagcttttttctcaacagataatcctttaaggatagctgccatttcttttgttttagccgtatcaagagtaagatcttcaagaacgatgatgttgttgtcgttcactttagaagacaatactgatttgattgccaagcggcgaacttttttaggtaatttataagaatagctgcgtggtgttgggccgaatacgacaccacctccgcgccattgcggtgaacggattgaaccttgacgggcacgtccagtacctttttgacgccatggtttacgacctccgccgcgtacttcagaacgattttttactttgtgagttccttgacgtaaggaagctctttgcataagaatagcgtcgaatacaacactctcatttggttcgataccaaatacagaagcgtttaattcgatgtcaccagcagtagaaccgttttggttgtataatgctacttttggcataatcaatttcctcctttcctaagagaattatttagatttaacagcacttttaacagtgattaaagatttcttcgcaccaggtacgttacctttgatcaaaagaagattgcgttctgcatcaacttttacgatttcaaggttttgaacagtgatttgctctccgcccatacgtccaggtaataatttacctttgaatacacggttaggatctacaggtcccattgaaccaggacgacggtggtagcgtgaaccgtgagacataggtccgcgagattgtccgtggcgcttgatcgcaccttggaaacctttacctttagatactcctgttacatctacgatttctccagcagagaaaatttcaaccttgacttcctgaccaacttcatacgcatccatttccactccgcgtaattctttaacgaagcgcttaggagcagtttccgcttttgcaacgtgccctttttcaggtttgttagaaagcttttcacgcttgtcgtcaaaaccaagctggattgcttcataaccgtcgttttcagctgttttcttttgaagaacaacgtttggagcagcctcgataacagttaccggaataagatcaccattctcagcgaatacttgcgtcataccaatttttcttcctaagattcctttggtcattcgtcacacctcctattaagatcattctatattttagaattaaagtttaatttcgatatcgacaccagatggtaagtctaatcgcataagagcatcaacagtttgtggtgttgggttcacaatgtcgattaaacgtttatgtgtacgcatttcaaattgctcacgagaatctttgtacttgtgcaccgcacgaaggattgtgtaaactgatttttcagttggcaacggaatcggaccagatacgctggcaccagaacgttttgccgtttcaacaatcttctctgcagattgatcaaggattctatgatcatatgctttcaaacgaatacgaattttttgttttgccattattttccctccttttcgcctacatcacgttagacagttctccgtgagaaaaacctgaacaccttgccatggcaaagcggccgggtgtgtcagcaacctctcacttcatcgcagtcaaagaccaacatacaccattatacagaaaataggcgcatgttgcaagacttatttaaaatatgcatggtttgcacactttttttattatacaggggtttttcttatttatcaaggatctatcataaatggtgtcgtgcatgtcgacttaatgtgttcgcgaataatgacggttcctcaatatgcggggtgtgagctgatttctcaaattgaaaccagcgcttttcgggtgcctcaagtttatgataatactgtttcgatatttcagcaggaacaattaagtcatgtttccctgaaatgaaaacacacggtactttaatagaaggaactgatgtaaaagcattaaaccggtacaactcatcagttaaatgttttttactgtagcgcaatccattaaggaagctgtgcatgttccgcactccatactcattgccagtaagcatttgaaataatacagctagagattgacgatgacggcgagtgaagcctcccctgcttagctcgacacaaaaccgatagataaggtgctggatatcctgcttccaaggcggagcaccaatgaaacgtatgaggaaagataataagctggctttttttgattcagaaatttcacgaatatgttgataagcagttgattcttcatcgtgggggttaacaacctggctgattccataatacgcgtaaaataaatcaggacactgctgcagcacatgaagcgccagtattgacccccacgaatgaccggctaggtaaagttttgattttgaaaaatgagctaaaagccattgagtgacttggattgtatctttaatgaagtgatttattgtcatagagtgatgcgaaattcgcttagaataagaaagccccgatcctctctgatcccaatgaactactgtaaaatactgttccagctctttttgataatgtctaacatatccgatttgcggcgttcccggcccgccatgtaaaaaaagcagcaatggatttttcacatcaactccattaatcattagcatttgctttgtattcccaatgcttagttctttcatgattgcgattgatttcttttcaggaatcataaatattagcccctcgaatatgatagatcctattatacaagaaaaagataagcaaacaaaaaacgagacccgtaggggtctcgtttaaaatcatactattactcagtgattgtagaaacaacgcctgaaccaacagtacgtccgccttcacgaatagagaaacgagttccttcttcgatagcgattgtagaaataagttcaacgttcatttcagtgttatctccaggcataaccatttctacgccttctggaagatggatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgaccacgttggatttcttcacgagatacaccgcgaagaagggcaccaatgttgtcaccagcttcagcgtaatcaagaagcttacggaacatttcaacacctgtaacagttgttttcttgttctcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcatcaaccgcatccataagttcgaagattttagcttcccactcagcgtctccttcaagagctttaagagcagaacctttaacaactggtacatcatcaccagggaagtcgtattcgctaagaagatcgcgaacttccatttcaactagttcaagaagctcttcgtcgtctaccatgtcgcatttgtttaagaatacaacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtttcagtttcgtactcaacgtgtgcagtagagatcgtgataccgcgctcacgttcttctggagcaccatcaatttgatcgtacgccatagctgtacctttaccagatttcttatgaagtactgttgtgatagcagcagttaaagttgttttaccatggtcaacgtgtccaattgtaccaatattggcatgtgatttggaacggtcgaatttttctttagccattctaaaatcctccttaagagcttttaattagtaatgtatagagtgataggaagtgaaagaaagctttcacttcctcatcttacaatagtagttatacttgagttaagcggcaaaatcaattattcgcctttattttttttgataatttcttctgcgacgctcttcggcacttcttcgtagtgatccatgtgcatagtgaacgtaccgcgaccttgcgtattagaacgaagtgcagtagcgtaaccgaacatttcagcaagaggaaccatagcgcgaacaacttgagcgttaccgcgtgcttccataccttctacgcgtccgcgacgtgaagtgatatcacccatgatatctcccatgtattcttctggaataaccacttctactttcatgattggttcaagaagaactgggttacatttgctgactgcatttttcaatgccatagaagcagcaactttaaatgccatttcgtttgagtcaacatcatggtaagaaccgtcgaaaagtttagctttaatgtcgataagcgggaagcctgctagtacaccattttcaagtgcatcttccagacctgcttgaacagctgggatgtattcacgaggaacaaccccaccgacaatcgcattttcaaattcaaagccagcgccttcttcgtttggttcgaattcgatccaaacgtgtccgaactgaccgcgtccaccagactgacgtacgaatttaccttcaacttttgcaccggtacggaatgtttcacggtacgcaacttgaggagcaccaacgttggcttctactttaaattcgcgtttcatacggtcaacaatgatatcaaggtgaagttcacccataccagagatgatcgtttggccagtttctgggtttgtttgagtacggaatgtaggatcttcttcagcaagtttcgctaaagcgatacccattttatcttggtcagcttttgatttaggctcaatagcaacgtcgataactggttctgggaattccattgactcaaggataacaagatccttctcatcacatagagtatctccagtagttgtatcttttagacctacagcagctgcgatatcccctgcgtatacagtagagatttcttcacggctgttagcgtgcatttgaagaatacgtccaacacgctcacgtttgcctttagtagagtttttcacgtatgaaccagaatcaagtgttccagagtacacacggaagaacgtcaacttaccaacgtaagggtcagtcataactttaaatgctaatgcagagaatggctcttcgtcagaagaatgacgctcaatctcttcatttgtatcaggacgtgtacctttgattgcagcaacgtcagttggtgcaggaaggtagtcaagaacagcatcaagtactagttgaacacctttgtttttgaaggcagaaccaacaagaacagggtagaattcaacatttaatgtacctttacgaattcctgcttttaactcgtcaattgtgatttcttcaccctcaaggtacttatccataagctcttcatcaagctcacatacagcttcaataaggctgttgcgaagctcttcagcttgctctttgtactcttcagggatttcttttgcatcagaacgagttccgaggtcatcttcgtagaaatacgcaacgttttctacaaggtcgatgataccttcgaagttatcttcagcaccgatcggcaattgaattgcatgagcgtttgcttgaagacggtctcttaaagttcctacagagtaaaggaagtctgcaccgattttgtccattttgttaacaaaaacgatacgcggtactccataagttgttgcctgacgccaaacagtttctgtttgaggctcaacgcctgattgcgcgtcaagtacagcaacagcaccatcaagtacacgaagagaacgttcaacttcaactgtgaagtctacgtgtcctggagtatcgatgatgtttacgcggtatcctttccactgtgcagttgtcgcagcggaagtgattgtgataccacgttcttgttcctgctccatccagtccatttgtgaagctccttcatgagtttcaccaattttgtggatacgaccagtatagaacaagatacgttctgtagttgtcgttttaccggcatcgatgtgagccatgataccgatattacgagttttttctaaggagaactctcttgccattgggtaatttctccttccttattaggaaattgtgttttgttaatctataaatcctaccagcgatagtgagcaaatgctttgtttgcttcagccatcttatgagtgtcttcacgtttcttaacagcagcaccagtgttgttagctgcgtcaaggatttcgttagctaaacgctcttccatcgttttttctccgcgaagacgagcgtagttaactaaccagcgaagtccaagagtcgtacgacgttcaggacgaacttctacaggaacttggtagttcgcaccacctacacggcgtgcttttacttcaagtacaggcatgatgtttttcaatgcttgttcgaaaacctccattgcatcattgccagtacgttctttaatgatatcgaatgacttgtataggattgtttgagacttaccttttttaccatcgatcatcattttgttgattagacgagatacaagcttagagttgtaaatcggatcaggtaaaacatctctttttgctacaggacctttacgtggcatctgaatatcctcccttcatcaattatgcgtattttcgtatattattttgctttaggttttttcgtaccgtatttagaacggccttgtgcacggttttcaactccagcagtatcaagcgcaccacgaacgatgtggtaacgtacccctggtaagtcttttacacgtccgccgcggataagtacaacactgtgctcttgcaggttgtgaccgataccaggaatgtaagcagtaacctcgattccgttagtcaaacgaacacgagcatatttacgaagtgctgagttcggttttttcggtgtcattgtaccaacacgagtacataccccgcgtttttgtggagaagatacgttagtgtgctcttttttaaagctgttgtatcctttgttaagtgcaggagactttgagttttctactttactcacgcgtcctttgcgaattagctgattaattgtaggcatgaatttttcctcccttcattacgttttataacccacatacccaggtggttcatcaaaaggcaaaaaacaatgtctttacacaagatggaatcttacgcaaaaacaaaagtacgttataaaataatggcaacagcggctgctcctacctcaattccgcaggctttgccgagctttttcatggattcaaccattgagacagagataccttgatcttcagcaagtgaaacaacacttgacgtgagtatcggatctgcgtcttttgcaacgactacttcctttactgaacctcgctttagagctttcactgtttgcttcgtaccaataataattgatttggcctgtgatactttatcataagacataaacatatcctccaaagtaacaggtttatttcgagcaccttggttatattatcattctaggagacgaatgtcaacaaggtatgacattttttagtttcgttcttctcatagagtgactttttcataaatatatctgctgaaagactgtttttgcagtctttcagcagcattaaatcagttattcaaccggaaccatatcgtcagtcggctgaacatttgatactggttttactttacggtatttcatcattcctgtaccagctggaacaagcttaccgatgataacattctctttcaagccgagaagctcgtcacgcttacctttgatcgctgcatctgtaaggacacgtgttgtttcctggaaggaagcagcagataagaatgaatcagtttcaagagatgcttttgtaataccgagtaagacaggacggcctgtggcaggtcgattgccttcaagtaatacctttttgttcgcttcagtaaattggtgaatatcaagcaatgtacctggaagcacatcagtgtcaccggcatcaattacgcgtactttgcgaagcatctggcgaaccattacttctacgtgtttatcaccgatttcaacaccctgcatacggtaaaccttttgaacctcatggagaagatactcttgaacagtcgtcaggtcagtcactttaagaagttctttcggatcgattgaaccttctgtcagtacttggcctcgagtaattttatctccttccgctactttcaggcgggagttgtaaggtgccgtataagaacgtgtttccactgcgccttgaaccacaatttcctgttgcttatcacgaacttcattgatctcaacgactgtaccgtcgatttctgtaattgttgcctgacctttcggattacgcgcttcgaaaagctcttggatacgcggaagaccctgtgtgatatcgtctccggcaaccccgcctgtatggaatgtacgcattgttaactgtgtaccaggctcaccgattgattgggcagcaatgattccgacagcttcaccgacttcaacatcggagccagttgcaagatttcggccatagcatcgtttacatacaccatgaggcgtattacatgtgaaggcagaacggatccacacttcttcaataccggcttcgacaatctccagtgctttatcttcatcgatcagttcgttttcattcacaagcacttcacctgtttcagggtgcttcacttgttttcttgcaaaacgtccgattaagcgttcttctaagcgctcaattgtttcagttccttctttaagaggcttagcaagaatgcctcggtcagttccgcaatcagtttcacggatgataacatcctgcgcaacgtcaacgagacggcgtgtaaggtaacctgagtcagcagttttaagagcggtatcggcaagacctttacgcgcaccgtgtgtggagataaagtactccaatactgtcagaccttcacggaaacttgatttgatcggcaactcaatgatacgtccagccgggttggccatcaggccgcgcattccggcaagctgcgtaaagttagatgcgttaccacgggcaccagagtcactcatcatgtagatcgggttgagttcatcaagtgatttcatcagtttgccttggataacgtcttttgcagcactccagatagagatgactctctcatagcgttcttcttcagtgataagaccgcggcggaactgcttcataacgttgtcaactttgctttgcgcttcctcaagaatttcttgtttatcatcgagtacgacgatgtcagaaaccccaactgtaataccagctttagttgaatatttgaagcctaggtttttcatgcggtcaagcattttagacgtttcagtaatatggaatcgtttaaagatttccgcgatgattttacccagaatgccttttttaaacggcgcattgattggctgctgtgcgataacagctttaacgtcagcacctttttctaagaagaaacggtcaggtgttttctcttcaatgttgctcttcgttggttcattcatgtaagggaatgattccggaagaatttcattgaagacaagcttaccgacagttgtaattaacaattttgagcgctgttcttcggtaaatgtcacattcttaagtgagttagctgcaacagctactctcgtatgaaggtgaacatatccgttttgataagcaagaagcgcttcgtctgtattcttgaagaccataccttcaccgacagcaccggcacgctcaagtgtcaggtaatagttacctagtaccatatcctgagacggtgttacaaccggtttaccatctttagggttcaagatgttttgagcagcaagcatcaagatgcgtgcttcagcttgtgcttcagcagataatggtacgtgaaccgccatttggtcaccgtcaaagtcagcgttgtaagctgtacatacgagcgggtgaagacggattgcgcgtccttcaacaagcgttggttcaaacgcctggatacctaatctgtgaagtgtaggggcacggttcagcagtaccggatgctccttaataactgattctagtacatcccaaacttcaggctgtacgcgctcaattttgcgtttcgcactcttaatgttgtgagcaagacctttttcaacaagttctttcataacgaaaggtttgaaaagttcaagcgccatttccttcggtaatccgcattggtacattttcaaatgaggaccaacaacgattacagaacgtccggagtaatcgacacgtttaccaagaaggttttgacggaaacggccttgcttccctttcagcatgtgagaaagagattttaacggtctgttaccagggcctgttacagggcgtccacggcggccgttgtcaattaaggcatcgacagcctcttgaagcatacgcttttcgttttgaacgatgatgctaggcgcaccaaggtccaaaaggcgtttcaaacgattgttacggttgatgacacgacgataaaggtcattcaaatcagaagtcgcaaaacgtccgccatctagctgaaccatcggtctaagctccggaggaataacaggaagcacatcaaggatcatccaagaaggcttgtttcctgagttacggaaggcttctaaaacttcaagacgtttgatcgcacgagtacgtcgttgtccttgtgaagttttcagctcttcttttaacatatcaacttctttgacaagatcgatatcttgaagaagtttatgaattgcttcagcacccatagatgcttggaatttattaccgtatttatcaagataagcacggtattctttctcagacagaagctgtttcttttcaagcggtgtattcgccggatcagttacaacgtaagaagcaaagtaaatgacttcttctaaagcacgaggtgacatatccagcacaagacccatacggcttggaatacctttgaaataccaaatgtgggaaactggggcagccagttcaatgtgccccattctctcacgacggactttagcccgtgttacttcgactccgcagcggtcacaaactacgcctttataacgaactcgcttgtacttcccgcaatgacattcccagtccttagtcggtccgaaaatgcgttcgcagaatagaccgtccttttcaggttttaacgtacgatagtttatcgtttcaggctttttcacttcaccaaaagaccatgaacggattttatctggtgaagcaagaccgatgttcatatactcaaaattgttcacatctagcaaggggcctacctcccttttttcttcggattaaccgatgtcacttgcctttataactagagattattcttttgttactacatcgcgttcaacgtctgcagatgctgtttcttccggctcttcatcacctgataatgccaggccgtcagcttgtttcgcatcttcttcgtcttctaaatctctcatttctatttcttcttcatcaccagaaaggattttgacatccatacctaagctttgaagttctttgattaatactttgaatgattccggaacacctggttcaggaacattgtcgcctttaacgatggcttcgtatgttttcacacgtccaaccacgtcatcagacttaacagtcagaatttcttgaagagtgtaagccgcaccgtaagcttcaagtgcccaaacctccatctcaccaaaacgctgtccgccaaattgcgctttaccgccaagaggctgctgcgtaacaagtgagtaagggcctgtagagcgtgcatgaagtttatcgtcaaccatgtgagctagtttgatcatgtacatgatacctacagatacacggttatcaaacggctctccagtacgtccgtcgtaaagcactgttttggcgtcacgagacatgccggcttcttcaagtgtttcccagacatcctcttctcgcgctccgtcaaatacaggagatgcaatgtgaatgccaaggtaacgagcggccatacccatgtgaagttccaatacctgcccgatgttcatacgtgatggtacgcccagcgggttaagcatgatatcaattggtgtgccgtcaggaaggtaaggcatatcctcttcaggaagaatcttagagataacacctttgttaccgtgacgaccggccattttatccccttcagaaatcttacgtttctgaacgatatatacgcgtactaactggttaacacctggaggaagttcgtctccgtcttcacggttgaagactttaacgtcatggataattccgccgccgccgtgaggcacacgaagagaagtatcacgaacctcgcgggctttctcgccaaaaatggcgtgaagaaggcgttcttctgcagtcagttcagttacgcctttaggcgttactttaccaacaagaagatctccgtcttttacttctgccccaatacggatgattccgcggtcatcaagattgcgaagcgcatcttcaccgacgtttggaatatcgcgagtgatttcttcaggtccaagtttcgtatcacgtgcttctgattcgtattcttcaatgtggatagatgtataaacatcatccttcactaggcgttcactcatgatgatggcatcctcatagttgtagccatcccatgtcatgaagccgaccattacgttacggccaagtgcaagttcaccaagctccatagaaggaccgtcagcaaggatttctccttttaccacttcatcgccgacacttacgatcggacgctggttgtagcacgtaccttggttagagcggacaaatttcagcaggctgtatttatccaggtttccttttactttttgaccgtctacttcttcatatcggcgaacccaaacgtttttcgcttctacgcgttcaacgataccagggtgtttacaaataacagcggcaccagagtcttttcctgatacgtattccataccagttccaacaaatggagcttccggttgcatcaaaggcacagcctgacgctgcatgttcgctcccatgagggcacggttggagtcatcgttttctaagaacgggatacatgctgtcgcagcagatacaacctgcttaggcgatacatccatgtagtctacacggtttctggaaacaacagtgttctccccgcggaaacgagctacgatgctgtcatcaataaaggcgccttcgtcatcaagacgagcattcgcttgagcgacaacatagttatcctcttcatcagcagttaagtaatcgattctgcccgttaccttccctgtttcagggtcaacgcggcgatatggcgtttcaataaagccaaaacggtttacttttgcataagatgatagtgagttgatcaaaccgatattcgggccctcaggcgtttcaatcggacacatacggccatagtgggagtagtgaacgtcacgcacttccattccggcacgctcacgtgtcaatccgcccggtcctaatgctgacagacgacgcttgtgcgttaattcagcaagcgggtttgtctgatccatgaattgagaaagctgtgagcttccaaagaactctttaatggacgcaataacaggacgaatattgatcagctgctgaggcgtaattgtattcgtatcttgaattgacattctctcacgaaccacacgctccatacggcttaaaccgatacggaattggttctggagaagctcgcctacagaacgtaaacggcggtttccaagatgatcgatatcatctgtgtcgcctactccgtgcagcaagttgaagaagtagctgattgaagaaataatatcagcaggcgtgatgtttttaatctcttcttcgatgtaagcattgccgattacattaataacctgttctccttcttgatcagtcggagcaaagattttaattgattgaagagtcacttcatcttcaacaacgccgccattcggatacagctttctaaaaccgattccgttttctaagtatggcagtactttatcaagtgttcttctatcaagaatctggcctttttcagcaaggatttctcctgtttcaggatcaacaagcgtttcagcaagtctctgattgaagaggcgattcttaatatgaagttttttattaattttatagcgtcctacattggcaagatcgtatcgtttcggatcaaagaaacgagaatcaagcaagcttttcgcattttctactgtaggcggctctccaggacggagacgctcgtaaatttccagcaacgctttgtcgctgttttctgtgttatctttatcaagcgtatttcgcaggtattcgttttctcctatgagatcaagaatctcttgatcggagccgaagccgagagcacgcaaaagaaccgtaaccggcaacttacgtgtgcgatcaatgcggacataaacaacatctttcgcatcagtttcgtattctaaccatgcgccacggtttggaatgacagttgcggtaaaaccttttttaccgtttttgtctactttaccactgaaatatacacttggagaccgaacaagctgggaaacgataacacgttccgcaccgttaatgataaaagtacctgtatctgtcataatagggaaatcacccatgaagacatcttggtcttttacctctccagtttctttgttaattaaacgaaccttcactcttagcggagctgagtaagtcacatcacgttcttttgattcctctacaggatatttaggctcacctaaactataatcaatgaactcaagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatttcttccaaagaaagaaaatacttttacaagacaaaagaaaaaagggtttctaattaagaaaaccacatccaaaaacaaataccgattttattagcatttccatacttgtataatttatacatagatattgacaattcatcatatcaagcaaaatatatacattggcattttacaatattaacatagttaaaataccgagtcaaactttttttgcttttatgatataatagcctttctttttttgaacgacggaaacttcatcgaacagttcctcgagcttttcaatggcagaaggcgcgccttgctttttctgtatgacgatccacaattcacctgaagcttttaagtgttcagcgcttttctcaaagatagcatggacaactttttttccggctcggattgggggatttgtaagaatagaagcaaatgtttgagcagaatcaacgtttgaaaacaaatcgctttgataaatcttaacgtttgttattccgttttgttccgcattttcatttgatagttctacggctctctcattaacgtcaatcatgtggatagtccggtctttaaagtcgctggcgagcgataaaccaatcgggccgtacccgcagcctacatccaaaatgccgccctcaacctcaggctcttcaaaagaatcaatcagcaggcgggagccgaaatcaacttcttttttagaaaaaaccccgctgtcgctggtaaacgtgaaatctttattccgaagcctaaaagaccaggtttgcttgttgctttttactgaaggtttttctgaataatagtgctcactcattattagaacctccttttttcatggcttaaagaatggcaaagaaaaagctcgcctcataaaagcgagcttcccctacaggtaagtgaagattacttaacttctacagaagcgccaacttcttcaagtttagctttaagctcttcagcttcttctttagcaataccttctttaagtggttttggagtgttgtcaacaagttctttagcttctttcaagccaagaccagtgatttcacgtacaactttgataactttgattttttgagatcctgcaccagcaaggataagatcgaattcgctttgctcttcagcagctccgcctgcagcagctccgccagctacagctacaggagcagcagcagttacgccaaattcttcttcgattgcttttactaggtcgttcaattcaagtacagttgcttctttaacggaagcaatgatttcttcgatatttaaagccatttgtaattcctccattttgttttaatttatgaaaaactgattagattaagcgccttgttcttccttttgttctgccacagcttttgtagcaagagcaaggttgcgaactggagcttgaagtacgctaagcaacatagaaagcaagccttcgcgtgatggaagttcagcaagagctttcacttcttcaacagtagaaactttaccttcgataacgccagctttgatttcaagagcttcgtgatttttagcgaagtcattaagaactttagccggagcgacaacatcttcagtgctgaatgcgatcgcgttcggtccagttaagaaatcattcaaaccattaagctcagcttgttcaaccgcacggcgagtcatcgtatttttgtaaactttgaactcaacgttagcttcgcgaagctgtttacgaagttcagttacttcagaaacgttaagtccgcgatagtcaacgatgatcgttgatttactttctttcagtttagaagcaatttcttcaacaacaactttttttgtttcaattgcgctgctcatggttacacctcctgtagattcttgtgtaacacttataccgttaggtgatcacgactgagacgacggattccatataaaaagcctccatgagacatggaggctgtatatacaagcatacgtaacgtaatagctgtgataatatacacctcggtaggataattaagcggataggcccctactgtctacggtataaatgatattctattttacaacattttgaataatatcagaatgttgatgtcatgtcaatattattttacgttaaaagttgaagagtctactttgacaccaggtcccatagtagaagttacagcaacgtttttcacgtaaacgcctttagctgcagcaggtttagctttaaggattgtatcgtacattgttgtgaagttctcaacaagtttttcatcctcgaaagaaactttaccgataggaacatgaatgtttccagctttatcaacgcggtattcaactttaccagctttgatttcgccgatcgctttttcaacttcgaaagtaactgtaccagttttagggtttggcattaaaccttttggtccaagtacacgaccgattttaccaacttcacccatcatgtcaggtgtagctacgataacatcgaaatcgaaccagccttgttgaattttgttgatgtagtcagtatcgcctacgaaatctgcaccagcagcttcagcttctttcgctttttcgccttttgcgaaaacgagaacgcgctgagttttaccagttccgtttggaagcacaactgctccacggatttgctggtcgtttttacgagggtcaacccctaaacggaaagccacttcaactgtagcgtcgaatttagctgtgtttgtttttttaacgagagctactgcttcagagacgtcgtaagctttagaacggtctacaagcttagcagcttcaacgtactttttaccttttttagccattttaaaatttcctccttatgtggttatagcggaataacctcccacgaataagggttgcgaacttgttaaaactcgcaacccgacaagaaacaaattaatcctcgattacaatacccatactgcgggcagtaccttcaaccatgcgcattgccgcttcaacgtctgctgcgtttaagtcaggcattttcgtttcagcgatttcgcgtactttatcgcgcttaacggttgccactttattacggtttggttcaccagaaccagactcaattccagctgcttttttaagcaatactgcagcaggtggagtttttgtaataaatgtaaatgaacggtcttcgtaaaccgaaatttcaacaggaatgattaaaccagcttggtcagctgtacgagcgttaaactccttacagaatcccatgatgttaacaccggcttgaccaagtgcaggtccaactggtggtgctgggttagcttttccagcaggaatttgcaattttacaactttaactacttttttagccacgagacacacctccttaagtccgtgatgtggtaatagggtaaaccctcccactcaaggtttcattctttatatgaatgacgaaatatcatgctagttgccttggataagtccaagacgtacctttgctatattatcatttatatatagcaatttcaagttttttcacattacaatttatcgatttgggtaaattccagctcaaccggcgtttcacggccaaacatattaacgaaaactttgaccttgcttttatcataatcaatctcttcaattgatcctgtaaagttagcaaaaggtccgtctattactttcactgtctctttcagttcaaagtcaatatcagtttttcgttcatccatgcccattctcttcagaatggtttctgcttcgcccggaagaagcggcgtcggttttgaacctgacccggcagatcctacgaatccagtaacgcccggcgtgttgcggacaacataccaagagtcgtctgtcattacaatttcaacaagcacataaccagggaatactttctttttcacgacttttttcttgccgtttttgatatctgtttcttcttcttcgggtacgactacacggaaaattttatcctgcatccccattgattcaacacgtttttccaagttggcttttactttattctcataaccagagtacgtgtgaacaacataccaattcttttccattctattcaggactgtccagtccttccctccccgcatttggttttagtgaattaccataacgcttcaaaaaataggcggcaagcctatgataactttcattttaagccacaataaaaaacccgctgaacgggttttggcaagtaatattatgatctattatagcacgtattgctgatcattattcaactattaaacgaattaattgagaaattcctgtgtcaaggagggcaaaaaagataacaaaaaagataactgttgaaattaccgtaatggtataacgcgttaactcttttcctttaggccagcttacctttttcatttctttcccaacatctttaaagaatttcataatacgcatgtaaaagacctccacaatttaaaagcgcaaaaactattttgtttcaagatgagctgtatgtgaattgcaagtactgcagtatttctttacttctaatcgctcagccgctgatgcagagctcttcattgtcgtataattacggtttccgcatgtcttgcatgctaacgtaatcttttttctcatgtcattacacctttttctaaatagacattagttcttatctttagtaacatatcatagtcagaaaaatactgtcaatatagcataaattcctattacaaactgatttcgcgaatttccaagtacttctccagcttgcgtttcacacgctgaagggcattgtcgatcgatttcacatgtcggttcagttcgtcagaaatctcttggtaacttctcccgtcgagatataagacgagtacttttctctctaaatcacttaatagttctcccattttcatttcaatatcatcaaattcttcctgattaatgatcatttcctcaggatttaaggttttcgctcctgaaatgacatccagcagcgttcggtctgattcttcatcaaaaatcggtttatctaatgagacgtaggaattcaaaggaatgtgtttctggcgagtagctgtctttattgcggtaataatttggcgggtaatacataattctgcgaaagctttgaatgaggtaagcttgtcctctttgaagtcacgaatagacttatagaggcctatcatgccttcctgaacaatatcctctctgtccgcccctattaagaaataggatcttgcttttgcccgaacaaagtttcggtacttcgtaatcaagtaatctaacgcatcactgtccccaacatgaaccttttcaatgacctgctcgtcctccaactggcaaaactgctctttgttgaattttcccttgttgttctgtagattcactccgatccccccggcgcacgtagatagaaatattatacagtattgggcaaaaaagcgtcaacttaatctaagtctccccgcctccacttttcaaacgttttcaaaacctcttccgataaagcaattttacccgccggcttttcggaagtgatttttcttacccgtctctctattcgcctttcaatcgtttctacctctctcaaaagctcccgggccgatttccgcaatgccccctgtccgaaaatcgcccactgctcagtatagtcagaggtcgcaacgtgaatttgagtcgcaatattattcaaagcctgagcgagcttttctatccgctcatcagccgtctcattttcttttgtaaaaatcacttcaactctatggttggtctgttttttctcaagcccttttacgagatgcgcgtcaaaaacaacaataaccctgtttcctgtatacgattgatattccgccattttctgaatcagtacgtctctcgcctcttcaaaactgttcgcttttaaatccttcagctgcggccaggctccaatcatgttgtacccgtctactaacaggatatccatgggtctttattctcccagagggtttcgtttccggtagacttcatacatcaaaagaccagccgcgacagatgcatttagtgaagttacctttccggccatcgggagtttaatgagaaaatcgcacttttctttcacaaggcggcccatcccttttccttcacttccgatgactagagccaaaggcatattgccgtccatattacggtaatcctcacgcgcggacgcatccgttccgacaacccagattccccgctctttcatctcttctaacgtccgtgccaaattggtgactcttgctacaggaatgtgctcaattgctcctgttgaagcttttgccactgttgttgtcagcccgacagctctccgttttggaatgacgatgccatgagcgccgaccgcatctgctgtcctcataatggaaccaagattatgagggtcttcaagctcgtccagaatgaggaagaaaggctgttcatttttttcttcggctgctttatataaatcgtccagttctgcatattcatacgctgcaacctgtgccactacgccctgatgctgtcctgtcaccatttgatcgagtttttttctcgggacgtattgaatcgtgattccctgctttttggcaagctcaatcacttgctgtgcttgtccctttacggtgttttccgccatccacagcttatacagcttccgatcagattttaacgtctcgatcactgcatttttccctatgacgtaatcatgttgctgactcatttgttttcctccctgacgtcccgaattgtatagcttcggctacgagctgactaagtcgttcctcttttttctctagaaaaaggtagcccagaagcgcttcaaatgctgtactgtagcggtacgtctgaacatctgtatttttaggtattgtccctgacttggcatttctgcctcttttcagcaccgcttcctcttcttccgtaaaaaatgattgattctgcagaaaaaataggatctcagcctgtgactttgctgaaacaatccggcttgatttcttatgaagatcatttggtttggtaaagccctgcttaagcaggtgatgcctgacatacacttcaaaaatggcatcacctatataagcaagcgcaagaccgttaagctgcttagaatcttttatcgtatcaaattcaagcatctgttattgtccccgtttccagcgagtgccttgagccgtatcttcaagaatgatattcatgcttttcagctggtcgcggatctggtctgacaatgcaaaatcgcgattccggcgcgcttcatttcgcttttcgattaagtcttcaatctcttgatcgagaagttcctgctcacccaacgaaaaaccgaggacagaaacaatgcggtcaaacatctcaataaacgccgtaatcacatgatcagccgtatgatctttctgaagataataattggcgtgtttcgctaagtcaaacaagactgaaatggcattcgccgtattaaaatcatcgtccatcgcttcttcgaatgctttgcggtgttcttcaactttttcaagccattgatcgtcatcttcggttaaattcgtactgctgttcagacggtgctgaagattgctgtacgctgtttttaaacggttgaacgcgcttttcgtattctccagaagctcttctgaatagttaatcggatggcgataatgaacagatagcataaagaatctcaaaagctgcggatcatgctgtttaatgatgtcatgcacaagcacaaagttgcctagtgattttgacattttttcattatcaatattgatataaccattatgaagccagtacttcgcaaacgttttgcctgtcagcgcctcagattgcgcaatttcgttttcatggtgagggaatgttaaatcctgtccgcccgcatggatatcaatctggtcacccagatactttttcaccattgctgagcattcaatgtgccagcccggacgtcctttcccccaagggctatcccaagagatttctccttcttttgccgctttccacaatgcgaaatcaagagcatcttcttttttctcgccgactcggatgcgtgcacctgatctaagttcatcgattgattgctgagaaagctttccgtacccttcaaatgctctggttttgaaatatacgtcaccttctgattcatatgcgtagccctttttcacgagctgatctacgaattcgataatggcatccatgttctccattactcgcggatgaaggtcggcttttcggcagccgagcgcacctacgtcttcaaagtatgctttaataaaacgctctgaaatggtgggtacatcctcaccgagttcatttgccgctttaattaatttatcgtctacgtctgtgaagttagagacatactgcacatcatagcctttatactctaaatagtttcgaaccgtatcgtaaacgattgccggacgcgcgttcccgatatgaatataattgtaaaccgtgggtccgcatacatacattttcacttttccctcttcaagaggaacaaacgtttccttctgtctagtcaatgtattataaagtgtgattgtcatttttggttgatcctttcttttctgtcttcaagttctgccttcagctctaaaatctgctgttccaaagacttaaagcggtcagcaactggatcgggcaaatcctgatggtttaaatcgcgtcttacttttttgccattttgtacaacgacccgtccagggataccgacaactgttgaaaaatcaggaacatcatgcagcactactgaaccagccccaatctttgagccttcaccgaccgtaatagaaccgagcactttagcacctgtggctatcaatgcgtcatctttaatcgttgggtgcctttttcccttttctttccccgttcccccgagggtaaccccctgaaaaacggttacgttattgccgatttcacatgtctccccaatgacaacccccatgccgtggtctatgaaaaatcttctcccgattgtagcgccggggtggatttctatcccggtaaaaaatcggcttacttgagatataaggcgtgcaaggaaataaaattttcgtttatataaagcatgtgcaatccgatgcgcccatatagcatgtaaaccggaataagttaaaatcacttcaaaatagcttcttgctgcgggatcttgatcgaacacagtatcaatgtcttctttgagcattctaaaaaacacatgcttccccccgtttctctatctgatttcctctacccaataaaaaaagcgcctctgcatgtaaacatgacagagacgctttaaccgcgcggttccactctgtttgaaaagcagacttctgctctcccaacttcagcctgtaacggcggcggccgcctttgaatactggtttcaaaaaacgttcttcaaaggtcttaagggcgcacttctaaaacccggctcatggatctctctcagccaatggagatcctttctgtaatggcctaaagctttatactcttccctgtcaacaatcatttatttagatattttttaaacgctgaattgcagtctctttaccgatcaattcaattgattgcggcagttccggaccgtgagtttgccctgttacagcaacacgaatcggcataaacagttttttccctttatggccagtttctttctgcactgctttgatcgatgctttgatgttatccggagtgaactcctcaagctcttcaagcttcgctgcgaatgtactgagcacttcaggaacctgttcttcttccagaacagctttcgcttcttgattatactcgatctcatccgtaaagaacaaatcagtcagctcaacaatttccgcaccgtagcttaattgctcatgatacagggaaatcagtttacgaacccactcttgttcttcagcagaaagctcagtgccaactttgcccgctttttgcaaatgcggaagcgtcagttcaacaacctgatcaagatccagcttcttcacatattggttgttaacccattttagcttatgcatatcaaacaaagctggtgatttagataaacgatttacatcaaaaatttcaataaactgctcttttgtgaaaagctcttcttctccaaccggtgaccagcctagcagtccgataaagttgaacagcgcttctggcaggtagccaagctctttgtactgctcgatgaattgaataatggattcatcacgtttactgagctttttacggctttcgtttacgatcagcgtcatgtgtccgaactgaggaatatcccatccgaatgcttgataaatcataatctgtttcggtgtgttagaaatatgatcctcaccgcgcagcacgtgtgtcattttcattaagtagtcatcaatcgctaccgcgaagttgtaagtcggcgttccgtcctttttcacaataacaaagtcgccgatgccatctgattcaaacgaaatttcgccttttacgatatcattgaaggcgatgatttttccttccggcacgcggaaacgaatacttggttttctgccttcagcgataaatttctcctgttcttcctgagtcaggtctctgtgttttccggaataacgaggcatttctccgcgggcaatctgttcttcacgctctttttcaagctcttcttccgtacagtaacatttataagcaagccctttttcaagaagctcttcatagtacactttatagatatcgttacgctctgactgacggtatgggccgtactctcctccgacatccacactctcatcccagtcaatacctagccacttcagataattcagctggctttgttctccgccctcaatattgcgctttttatctgtatcctcaactcgaatgataaacttaccgccttgattgcgggcaaataaataattaaaaagcgccgttctggcatttccaatatgcaaatgtccggttggactcggtgcataacggacgcgtacttcgtttcccattttcaaatacttcctttcatgtcatgtatggcctcaggcaaaaatgtatgaatctattctaccaccaaatagacccggcatcaaaacaagttagcctttttgtatcagtactgtcgcctgagccgctattccttccgcccggcctgtaaatccaagcttttctgtcgttgttgcttttacatttacttgagaaacttctgcctcaaggccttcagcaattctttttctcatatcttctatgtacggcagcatcttcggcttttgcgctatgatggtgcaatcaatgttcccaaggacataccccttctgtttcacgattccccagacatgctgaagtaatttgaaagaatctgcgtccttgaactcgggatctgtgtcaggaaaatgcttcccgatgtctccttcacccacagctcccaggcaggcgtcagcgacagtatgcagcaatacgtctgcatcagaatggccaagcagccctttttcgtacgggatttcaattccgccaataatgagaggacggccctcaactaattgatgcacatcaaatccttgtccaattctaaacatgtttattcccactttctgattccatgatagcttcagctgacgtcaaatcgtctggcgtcgtcagcttaatatttgtatagctgccttctacaacacggaccgaaccgccctccatctgttcaacgaggctggcgtcatccgtccctaaaaatcccttgcgctcggcctcagcgtgagccttcatcaataaagaaagacgaaaagcttgtggcgtttggacagcccacaagcttgaacgttcaatcgtctcactgacttgtaaatcttgaacgcgtttaatcgtatcttttaccggaacagcaaggatggccgctcctgtctgttccgcctctgcgatcagttcgtcaatttgttcatgttttataaatgggcgggcaccgtcatgtacaaggacaatcttttcctgctttacggctttcagccccttatacacactgtgctgacgctcatctccgcctgcaacaagctcaatcgaagtttgaaacggataatcggtcagcatttgctgaaagtgctcccgctcctgctcgttaatcaccaaaatgattttatcgcactgccggtggctgtcaaacactcttaacgtgtgtatgatcaccgggtctcccttcagatcaatgaacagtttatttctccctgccttcatccgctttccctgtccggctgcaggaatcaccacatcataactcattgtttcttctccctttacagcgccttctccaacagcttaggcttcgcaaaaatcattcgtcccgctgctgtctgcagcacacttgtgacgagtacatcaatatgcttgccgatataatttcgtccttcttcaacgacaatcatcgtaccgtcatccaagtaggcaactccctgattatgctctttcccgtccttaatgacctgaacattcatttcctcgccaggaagcacaacaggcttgaccgcattggcaaggtcattaatgtttaatactgctaccttctgaagctcgcatactttatttaaattaaaatcattcgtcacaacgaccccggatgtcagcttagcaagtttgacgagcttgctgtcaacctcctgaatatcttcaaagtcgccttcgtaaatttcaacttcaatgtctaattctttctgaatgcggttcaggatatcaagaccgcggcgtcctctgtttcgttttaaaacatctgaagagtctgcaatatgctgcaattcctcaaggacaaactgcggaatcacgataactccctctaaaaaaccagtctgacaaatatctgctattctcccatcaataataacactagtgtccaaaattttcagcttcttgtcttgaacctcatgttcttcatcagctgttccttttttcttttgcattctggcggaaatggaaaacaggctgatcaattcatcctttttcttaaagcccacctggaagccgagataaccgaggaagaaagccaaaaatacaggaattattgtgctgaatatgcggtaaggtatattgtctaaaggaataacatttacgataagataagcaattataagtccaaaaactaagccaagacttccaaataacaaatctggaaccggcgcttttaacaatgaatcctctatccacttcacccagttcacaacgtattctgtaccccatatactgatgagaaaaaagataattgctcctattgccgcagacgtatatgcgtttgttattaaaggtatgtcctgtatatttaacagtacaaacaattcaggtatcaaaaatataccaacaacgccgccaaaaataatgaagaacgcctgaactattcgttttaacatacccccacctccttttttaacattttaatttcacaaagtcttatgcatcctacgaatatcagaataaacaaaaaccaacattaatatacccgtattcataaggttttaaccgaaatcacagttgtctgtctaaataatgcttctcttgcaggcgttttaatccttttttgattttttgggctcgtacttcaccgattccctctacttcatctaattcttctgcactcgcctcaataatccttggcaggactccaaatgcttctacaacattttcaacaatcggcatcggaagacgcggtatcttatttaacagcctgtatcctctcggcaatacataatcatcaagattagtagaagcagggtaaccgagaagcttatacacaatggaatcatccagcagatcataactggacatatcctgcagctccttcaagagaacaaacggatctttaatcttttcttttacatagtccttaataaataaagcggcctcttcttccatatccgtaatcaattcaatgacttgcagtttgatcagatgcccttctgtccccagctctttgatatacatattaatttcgtttttgattctcagtaccatttcataacgatgcatgacagacaagacatcactgaaggtaacaagttcctcaaactctaacgcgttcagtgcattaatcgttttatcgaggattgtcttatacttttcaagtgtttgaatggcttggttcgccttggttaaaataaatcctatgtcttttagtgtatacttcatgttttcctgatataacgttatgacatttcttctttcagaaatagcgattacaagacagccagtttgcttagctactctttcggcagttctgtgccgcattcctgtttctgatgaagaaattgtggcatccggcatcagctgagtattcgcgtagaggatcttttgacccgaatcacttaaaatgatcgctccatccattttagccaactcatataaatgcgccggagaaaaagccgtgtttatgtgaaagccgccgtccaccacttcttttactttatcattatatccaacaacaatcagaccgcctgtatttgctctcaagacgttttccatccccgctctgagcggtgtacccggagcaacaaactgcaatatagatgacaggtctaactcgtgtttcgccccttttttctctttttccatctattatcctcctaatgaagtacgaagcgcttctgcaacatttgctactccgataacctcaatcccttttggttttgtccatccgtccagatttgccgcgggtatgatcatgcgtttaaagccaagctttgccgcttctttcacacgctgttcaattcttgaaacccgccggacttctccggttaatcccacttctccaataaaacaatctgcaggatttggaggtgtgtctctaaagcttgatgcgatactaatcgcaatcgcaagatcaattgccggttcatcaagcttaacgccgccagccactttcaaataagcatcctgattttgcagcagcagtccaactcttttttctaacacagccattaacagagaaaccctgttatggtctattcccgttgccatacgccttgggttgccaaagcttgttggcgagatgagcgcctgaatttcaacgagaatcggtctagtgccctccatagaggcagtgatactcgagcctgcggaaccagcagagcgttcttctaagaaaatttccgaaggattcaaaacctcagtgagcccctcttcccgcatttcgaaaatgcccatttcgtttgtagatccgaaacggttttttacagcccgcaaaatacggaaagtatggtggcgttctccttcaaaatataaaacagtgtcaaccatatgctccaacagtctcggacctgcaatagacccttctttcgtcacgtgccctacgataaaaatcggaataccttttgtttttgcgattttcatcagctcagcagtacattctctgacctgtgacacactgcctggagccgatgtaatatcgctttggtaaaccgtttgaatagagtcaacaacgacaaacgctggattcatctcttgtatagcagacgaaatatactccatatcggtttcagataaaacatgcagtgacggattattaatgccgagacggtctgctcgcagcttcgtttgctttacagattcttctcccgaaatatacaggacactgtttgatgagcctgataattgagcggaaacctgcagtaatagcgttgactttccgataccaggatcaccgccaattaaaacgagggagcctttaacgacacctccgccgagtactctgttaaactcgccaagctgggttttgacgcggggttcttctgatgtttcgattgatgtaataggtgaaggtttctgtacagtttgaacagaatgagaaaaagccgctctccgattggccggtgcttttttaatcatttcttccaccattgtattccaagcaccgcagcccggacatttccccatccattttggagactcgtagccgcaggattggcagatgaatttcgattttgttttagccatatatagtgtaagacctctcccttgttctatttcttgatatgaaagtgaggcatacacttacatgctgtatgcctcatttccgtcttctatattaattcgttttagcagtcgtttttacgacaaattcgccatcttctacatcaagaacaatatgctgtcctttatgaatatttcctctgaggagttcttcagataaacgatcctcgacatgtttttggatcgctcttcttaacggacgggcaccgtattccaggtcaacgccctcttccgcgactttcgcttttgcagcatctgtcaattcgatagaaagatcttgttctttcaagcgtttcgttaattgatcagacattaatgacacaatttcagtaagatgttttttctcaagtgaatggaagacaatgatttcatcgatacggttgatgaactcaggtctgaacgctcgttttaattcacccatcactttatctttcatgtctttatgattttgagtttcatcctgaacgttaaagccgacatatttattgcgtttcagctcacttgctccgacgtttgatgtcatgatcagaatggtattgcggaaatcgactgtgcgtcctttagaatcagtcaatcgtccgtcttcaagaacttgcagaaggatattgaagacatcagggtgtgctttctcgatctcatcaagaagcacgacagagtaaggttttcttctgactttctctgtcaattgaccgccttcatcatatcccacatatcctggaggtgaaccaacaagtcttgaagttgagtgtttttccatgtattcagacatatcaattctgatcatggattcttcatcgccaaaaatggattcagcaagtgctcgtgcaagctctgttttacctacacctgtagggcctaagaaaatgaatgagccgattgggcgtttaggatctttcaatcctgctctcgcacgtctgacggcttttgcaacagctacaaccgcttcatcctggccgatgacgcgggaatgaagaatgttttccatattgagaagcttatcagtttcagtttgggcgattttagatacaggcacaccggtccagctggatacaaccatcgcaatatcatccacagtaacctctgagttttcctgcccttgcttctctttccatgatttcttcgtatcctctacttgctcgcgcaggcgttgttcagtatcacgcaaggaagcagctttttcaaactcttggctttgcactgccgcatccttctctttgcgaacctcatcaagcttctgctcaagctcttttaagttaggaggcgttgtaaatgagcgcagtctcacctttgaacctgcttcatcgatcaagtcaattgctttatccggaaggaagcggtcagaaatatatctgtcagaaagcttaaccgcagcttcaatggcatcatcagtgatagaaacgcggtggtgggcttcgtatctgtcacgcagaccttgtaaaatttgaatactttcatctacagatggctgatcaacctgaatcggctgaaaacggcgttccagtgctgcatctttttcaatatatttacggtactcatcaagagtcgttgcaccaatacattggagttcgccgcgagcaagtgaaggttttaaaatattagatgcatcaatagcaccttctgctccgcctgccccgattaatgtatggagctcatcgatgaatagaatgatatttcctgcctggcgaatttcatccatgaccttcttcaggcgatcctcaaattctccgcggtattttgtgccggcaacaactgttcccatgtctaatgtcatcacacgtttatcacgcaaaatttcgggtacttcattattgataatttgctgtgccaaaccttctgcgatagccgttttacctacacctggttccccaatgaggacagggttgtttttcgttctgcggcttaatacttcaatgacacgctggatctccttgcttctgccgattacagggtcaaggctgtcttccttcgcaatagcagttaagtctcttgccaagctgtcaagcgtaggcgtattcgcattgctgtttgttcctgccgctgatgatcctgtttcattacttcctagaagctggagcacctgctgtcttgctttatttaagctgacaccgagattattcagaactctcgcagcaacaccttctccttcacgaatcagaccaagaagaatatgttctgttccaacataagaatgaccgagttttcttgcctcatccattgaaagctcaatgacttttttagctctaggagtataatgaatcgtttgagacatttcctgcccgcgcccgatcaaactttctacttctttctgaattttatctgaaccgagtccaagcgcttgaagagctttagcagcaatgccctctccttctcttaccagtcctaataaaatatgctcagtgccaatgttattatgacctaaccgaagtgcttcttcctgtgctagcgccagtactttttgagctcgttctgtaaatcttccaaacatcatatcgattcatcctcctgtcttttcccattcatttctaagtgaagccgttctctgatgagagccgctcttcgaatgtccctttcgttcggacgcaaagcgcctcccgagtattgctgtaaaaatcctggctgcgtcaaaatcataagttcgttaagtatgttgcttgaaagtccttttataatgcctaggtctatgcctaaccgaacatctgaaaggcactttgcagtttctttcgattctatcatccggcaattagacaagaccccataagaccgatatacccgatcctcaagttcgattttagaagtttgataaatcgcttctcgggcagatcgttcttgttcaatcaactgagcagcaacactgttaagatcctctacaatatcctgctctgacttaccaagcgtgatctgatttgaaatttgaaagatattccctactgcttcgctgccttccccataaattcctctaacaactaagcctaattgattaattgccggtataattcgatttatttgcctagttaaaaccagcgccggcagatgcatcatgaccgaagcccttaaacctgtacctacgtttgtaggacagctggttaagtatcctctttgctcattgaatgcataatcaactttttcttcaatccagtcgtcgacctggtttgcggctttcattgcttctaaaagctgaaatccagggaaaagacattgaattctaatatggtcctcttcatttagcatgacgcttacttcctcattttcagaaagcaaacagccgccaaaaggagactctgtcagattcggactgattagatgtttttcaacaagtacacgcttctctaaaggctgtgcatcattcattctaatcaaaacaaatttgccgattccgggaatttcttgctctgaaaactgatcttcaaattgctgtatgatggatgaggcttcttcattggaataccgcgtagggaaccgaatatgctcaaagttccttgctaaacgtatgcggctgctgagtacaatgtcactttcaggtcctttctgcttcatccaactgcttagtgcgtcctgaataaaatgctttagcgacattactcctgttcctcctcactatctgtacttttgagtgattgttctaatgaacgaatttgatctcttacatgagctgcattttcaaattcttcttgatggattaaggattccaattccttttttagcatatcaatctgccgtctgacatgaagattgccgcctattcgtttcggtatcttacctgcatgcacagtgtttccgctgtgcactttacgtaggattggtgtaatgttgctatgaaatgttttgtaacattcagaacatccaaaacggccaatttttctgaattgctgaaaagtcattccgcatttcggacaagcagatatttgctccgagtgactgaacatttgagttcctgcattttgaaatgaagaatccatgttcagtaaacccgaaagtaaattatgaatagagaaaccctggtttgcacttataccatatgaatcactattttctttggcacattgttcacaaatatgaacttctattttttctccgttaacaacctttgtaaagtgaaaagtggctggtctctcgtggcactcttgacaaatcaatcttttcacccgcttattttaattttaaagaagtcagcattgccttcatcattctcgctcttaattcatcacgttcaggtaagtcaatgtgtaaaactgagcggtccattacgctgaccatcatttttgcttctctttctgaaattaccttgtcttctaatagccttaaaataatgtcatcagaggctgcttgagacaaatgggtattaatttgagaaataatattattgatcaggacaacttcattgttcattttaattttaatgattctgatgtaaccgccgcccccgcgtttgctctcaacaatatatcctctttcgcttgtaaatctggtgttgatgacataatttatttgggaaggaacgcattgaaatttatctgcaatttcacttcgtttaatctctaaaatttccttgccattttgatctaacactcgttttaaatattgttcaatgatgtcagaaatattatgtcccactcaaccccctcctttactgactttgactatatttgactataatcttactataagccgtttctcgagaattttcaactttctcgctctatcctttattatttccattttcccggtccacaaaacctgattgctgatttaaaattcggtataaagtttattatattatacagttaagtggaattttatgataccaataaaccaaaatacgtttactcaagatcgagaaaatcaaacaaatacaaacaccgagggcttatacagcccatatactgatttcaagtttcgaaaagatctaaatagtgtatacaatatccgttttaaggggaggctaattgtacggaggtggagaagatggacgaaacagttaaacttaatcatacatgtgtgatttgtgatctagagaagaatagaggcattcatctttatacgaaattcatatgcttagattgtgagagaaaagtaatttctacatcaacttctgatcctgactatgcgttttatgtaaaaaaactaaagagcattcatacaccgccattatattcatagacctgaaaaggtctttttttgtactcttaataataaaaagaagatgaaacttgtttaaggattgaacgtagtagataataatattaaaactgagtatagacacaggagtcgattatctcatgcagagattttttcactttttgatgtggagtttaactagcagtgcgacttttgttttcattggaatattgagcttttttggtttaaaccagtcgctttttttaactattgtttatgggcttgcttctggagcagccgtatatatagctggcatctggaatgcaagacggttatttcttaaaaagcatgaattgacaggaagagagtatgcttacattaagaaaaacttagaggaagcaaggcagaaaatgatccgtcttaggaaagccttgtttcaggctaaaagcattcaaatgtttaagcaaaatgcagaaatgctaaggattgtgagaaggatttatctcctcaccaaaaaagagccaaagcggttttatcaggcagaacgatttttttatcaaactctcgattcggttgttgaattgacagagaagtatgcttttctatcatctcacccaaaaaaaagcaaagaactgtcgatgtcgttaagtgagacacgcatcactcttactgaattgaccaagcgtttagaggaagatttaactcaggcaatggatgatgaaattgacgagttgcagtttgaattagacgcagcaaaacattcattaaagaaataagggaagagggtaagagcgatgaaccgagaccaaagcgaccttcatatagatgaattattggcagatccttttggtggtaacatagagataccaggttcggaggctgtaaaagcagagaaagagcaagtacggcttgttgatgttcttcctgaggaaaacaaggaaaaagcaattcagcttgctggacagattgatcataaaaatatgcaaagcattgtcttatacggttcacaagctcaatctaaactgctgaacttttctcatgatatgattaatcatgttcaaaagaaggatgtcggggagattggcgaaatacttggagagctgatgaaaaagctggagcaagtaaatcctgatgatctccaatctaagaaaaagggtattttggcacgcatgtttggaagagtatcaagttctcttcaagaggtgctgtctaaataccaaaagaccagtgtgcagatagacagaatcagcttgaagctggagcactctaaaaatgctttaatcagtgacaacaagctgttagagcagttatatgaaaaaaataaagaatattttgccgcgctgaatgtttatattgctgcaggagaactgaagctggaggaattaaaaacgaaaacaattcctgaactgaagcaacaggctgaatcgagtgatcataaccaaatggccgttcaagaggtgaatgatttaattcaatttgctgaccggttagataaaagggtgcatgatttgttgctgagcaggcaaattacaattcaaagtgcaccgcaaatcaggctgattcaaaatacaaaccaagcgttagctgaaaagattcagtcatccattgtgacagcgattccgttatggaaaaatcaagttgccattgcgctgacgcttttaaggcagcgcaatgcagtggatgcacaacagaaagtatctgatacaaccaatgagcttttgctgaaaaatgcggagcttttaaaaaccaatacaattgaaactgcacgggcaaatgaaagaggccttgttgatatagataccttgaagaaggtgcaggaaagcttaataagcacgcttgaagaaacactgactatacaagaagaaggacgaatcaaacgccgtcaggcagaagaagagctcatgatgatggaaggcgacctgaagcaaaagctgattacaataaaggaaagatgattaccagtaagtctggctttaagttctgtcagaggcacgatataataaggtgtaagaagacacattcaaaggattgttttcatgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggactggatgatctccatcatccttccggggtgattaaggaagctcaggagcttgtcagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttggccggtgctaagccggtttatcttgcacctgacgttgattcagcgatgcatgtgcctacgcatgttccgcttggaacaattaaagaggccctggaagcatatccagatgcgaaaggcttagtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgcctgccatgacgatgggttcttatttgcatcttaacagcagctgcaggattaacagggatcgggtggcagagtatttaaaccgattacaaagcagcagcccgtcttatccgataatggcttcgttagatattgcccgcgcttatgtacagcatattatagaagaacaaaagctttctgacattctgcagcggatacaaacacttaaacaaacgtttgattcacttacaaatgcagaagctgttaaccctgctaatccactgatcatcacggacccgctgaagctcacaattcgttcaaaacgcgggcattctggctatacgctgcaaagcatattagagcgtgccaacatattcactgagcttgctgatgaaaatcaagtactgctcgttctcccattgggaggaaaacggagaataaatgctgaaaccattagaagcatcgatgaaggaattgagaaaacgcctccggatcagacgtttgtttctgcagaatggggtgtgcagcctgttactgtcttgccttatccaaaaaaggtcttacattcgtttaagaaagaatatgtgagctttgaggaagcagctggccggctgaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcatgagctgtttatttattacattcgaaggtcctgaaggtgcaggaaaaacgactgttctgcaggagatcaaaaacatactgacagcagaaggccttcaggttatggcaactcgagagccaggcggaatagatattgcagaacaaattcgagaggttattctgaatgagaacaatacattaatggacccaaaaacagaagctctcttatatgcggctgcaagacgccagcatttagttgaaaaagtaaaacctgctttagaacaggggtttatcgttctttgcgacagattcatagacagttctcttgcgtatcaaggatatgcaagaggacttggaattgatgaggttctgtccattaatgaatttgccattggagatatgatgccccatgtaacggtttatttttcaattgatccggaagaaggactgaagcgtatttacgcaaacggctcacgggagaaaaacaggctcgatttagaaaaactggactttcatacaaaagtacaagaaggttatcaagagctgatgaagcgatttccggaaagatttcattcagttgatgccgggcaatccaaagacctcgtcgttcaggatgttctaaaggtgatcgatgaagcgttgaaaaaaattcaattgtgacctgtttcccaatagttgatataataatgtaaacgagatcacgttgtttccaatctaaaggaggccttcacagatgaaattgatagtggcagttgtacaagatcaggacagcaacagacttttgaaaaccttaacggatcacaacttcagagtcacaaagcttgcgacgacaggaggatttcttaaatcaggcaatacaacgtttatgatcggtgtcgaggatatacgcgtcaataaagcgttgagtctcattaaagaaaacgggcagaaacgtgatcagatgattgcccctgtatctccaatgggcggaaatgctgattcctatgtcccttatccagtcgaagttgaagttggcggagcgacagtatttgtccttccagtcgatgaatttcatcaattttaaggatctgaaactgtgaaaattaataaagatatacgtacatttatagataataagcagattccctctgtgaaaacatctgagatcacagcatcgtttaaaacatcaatggaaaaccaaagcagcaaaatgaagcttgatcagcttaccaggctgttatctgatatagaggcattcggaaaaaggctaacgaaatctcggaattttaaagacttagcgagatttaaaggacttgtgaaacgttttgtcaaagaagctgtggacagcggcctttcacatgaaacatcgaaaagctttgacctttacgggaacagcagaacgctgggacttgtgaaagaaatagatgacaaattgatacagcttacggaagagatgatggatcaggaaaaaccggcaatagatttgctggagcgtattggcgaaataaaaggtttattaattaacctttacacatagagagtgatacaatggcaatatcctggaaggaaatgaacgagcttcagcccagagtgatgaagcttttatataatagtattgagaaggacagactatcacacgcttatttgtttgaggggaaaaaaggaacaggcaagcttgatgccgcgctgcttcttgcaaaaagcttcttttgtctggaggatggcgcggagccttgtgagagctgccgaaactgtaaacggatagagtcagggaaccatcctgatctccatcttgttcagcctgatggcttatcaatcaaaaaggcgcaaattcaagcgctccaagaagagttttctaagacaggacttgaatcgcataaaaagctgtatattatttcgcacgcagatcaaatgacagcaaatgcggcgaacagcctgctgaaatttttagaagaaccgaacaaagacacaatggccgtcctcatcactgagcagccccaaaggttattggataccatcatttcaagatgccaaacccttccttttcagcctttgcagccgaaagcaattgaagatagactgatcgaacaggacgtctcgcctcatatggcaaggcttctggccaacatgaccaataatgtagcagaagcagtcgaattaagtcgaaatgatgagtttgcagagtctagagcgaaagtgataaaattgtatgaagtcctacaccagcggaaaggacatgcttttttctttattcaagatcaatggatgccctttttcaaagaaaaaacccatcaagaaatgggtcttgatatgctcttattgatatatcgtgatgtgttgtccatccaaataggaaatgaagataaattgatttatcaagacttattccaatcaataaaacagcatgcgctacaatcaacacaacaaagcgttacgaatcagatacttgctgttttagaagcaaagaaacggcttcattccaatgtgaatgtacaaggattaatggagcacttggtgttaatgttgcaggagggataagcttgtacaatgtaattggtgtccgctttaagaaagcgggtaaaatatattattttgatccgaatggatttcatatagaacatgacagctgcgtaattgtagaaactgtcagaggcgttgagtacggccaggtcgtaattgcaaataaacaggtggatgagcatgatgtggtgcttccccttcgaaaagtgatacgtgtggctgacgagcgcgatcttctcattgtagaagaaaataaacaggaagcactatcagcatttgatatctgccaaaagaaagtgattgagcatggcttggatatgaagctggtcgatgttgaattcacgtttgatcgcaataaagtcattttttacttcactgctgacggccgagtcgactttagagagcttgtaaaggatttggcttctatctttaagacaagaattgagctgcgccaaatcggagtgagggatgaggcaaaaatgctaggaggaatcggtccttgcggaagaatgctttgctgttcaacgtttcttggagattttgaacccgtttccattaaaatggccaaggatcagaacttgtctttaaatcctacgaagatttcgggtctttgcggacgattgatgtgctgtctaaaatatgagaacgatgagtatgagacggcaaaagaacagcttccggatataggagaaatgattacgacagcaaacggtcccgcgaaggtcgtcggactaaatattctggaacgggtgcttcaggtggaactgataaaccgtgaaaaagtgatagaatatacttgggaagagctcttggaagagggcgtcgtatccgcacaaaccacagattaacgaggtgtggaaccttggataaaaaagagttatttgatacagtcattaacttagaagaacaaattggctcactgtaccggcagctgggggatttgaagcagcatatcggtgagatgattgaggaaaatcatcatttacagcttgaaaacaagcatttgcgcaaacggctggacgatacgacgcagcagattgaaaagttcaaagctgataaaaaagaatcaaaaacacagaagacggagcaaactgatataggggaaggatatgataatctggcacgtctgtatcaagaaggatttcatatctgcaatgtccactatggaagtgttcgaaaagaggattgtcttttctgtctgtcattcttaaataaaaaatagggaaaaggcttccgcataagacgggagcctttttcaaaggtactgaaaggataagaagatggtttcattacatgatgatgaaagattagattatttgctggcagaggacatgaaaatcatacaaagtccaacagtgtttgctttttcgttggacgctgtgcttctgtccaaatttgcgtacgttccgattcaaaaagggaaaattgttgatttatgcaccggcaatggtattgtgccgctgctgctcagtacaagatcaaaagcagacattctgggagtcgaaattcaagaaagactgcatgatatggctgttcgcagcgtggagtataataagttggacgatcagatcgagatcatacatgatgacctgaaaaacatgccggagaaacttggacataatcgatatgatgttgtcacctgcaatccgccgtattttaaaacgccgaaacaaactgaacaaaacatgaacgagcatctccgaatcgcaagacatgaaatccactgcacgctggaggatgtcatttcagtcagcagcaagctgctcaagcaagggggaaaagcagctcttgttcaccggccgggaaggcttctggagatttttgaactgatgaaggcttatcaaatcgagccgaaacgtgtacaatttgtctatccgaagcaagggaaagaagccaataccattttggttgaaggtatcaaaggcgggcgcccggatttgaaaattcttcctcccttattcgtatatgatgaacaaaatgaatatacaaaagaaatcaggaccattttatatggagacaaataaccatttcttctacgtcgtgaaatgtaaggacaatagctggtatgccgggtataccaacgatctgcataaacgagtgaaaacgcacaatgatggaaagggcgcaaagtacacaaaagtaagacgtccggttgaattaatttttgccgagagcttttcaacaaagcgggaagctatgcaggcggaatattatttcaaaaaactaactcggaagaaaaaagagctttatatagaagaaaagcggaacagcaaggaggctgtatatgttaaggcgccaaatgagctttaatggaaagtcggacatggggattctttacttggtcccaaccccaatcggaaatttagaggatatgacattccgggcgatcgacacgctgaaatcagtggatgcgattgctgcggaagatacgaggcaaacgaaaaagctttgtcatgtatatgaaattgaaacaccgctcgtcagctatcacgaacacaataaagaaagcagtgggcacaaaattattgaatggctgaaatcgggaaaaaacattgctcttgtcagtgatgccggtctgccgacgatttctgatcccggagcggaaattgtaaaggattttacggatataggcggttatgttgttccgttgccgggagcaaatgctgcattaacagctcttattgcttcaggtattgtaccgcagccttttttcttttacggttttctcaacagacagaaaaaagaaaagaagaaggagcttgaagcccttaaaaaacggcaggaaacgatcattttttatgaagcgccccacagattgaaggaaaccttgtcagcgatggcagagatattaggagatcgggaaattgctgtaacacgtgaactcactaagaaatatgaagagtttatccgaggaacgatatccgaggtcattggatgggcaaacgaggatcagatacgcggcgagttttgtcttgttgtagaaggaagtaataatgaagaggtagatgaggaagaacaatggtgggaaaccctcactgcgaaagaacatgtcgagcattacatctcgaaaggcgctacgtctaaagaagccattaaaaaagcagcagtcgatcgcaatgtaccaaagcgtgaagtgtacgatgcttaccatattaagcaataaaaaaacgttcttgtgtcataacaagaacgttttttgtacaagaaatgattatttaaggttttgaagctggttttggatttcgctgatgatttgctcagcgccttctttactaagaaccaatttaccgcctgcaagtttaaggttatcatcagaaacttcaccagttacttggcaagtcatgtttggtttatattttttaaggatgattttttcatcatcaacatagatttcaagagcatctttttctgcgattccaagagtacgacgcagttcgataggaataactacacgtcctaattcatcaactttacgtacaataccagtagatttcataaacattctcctcccaagagatacttatttgtttaaattatatttttcttcgtcattattcgacaaaatccttaccttcatagcataacaaggtttccaataatcgtcaatcattttgtttactattgattgtaagaattagttcttatagtcagtaatgtcttagaaactaccgaaataacagcattttataaatatttaataaagctattatcctactaaaaatccttttaaatcaagactttcgaaccaaagttttttatttcatttgattatatacgacaaaattcgacacgaacagactttttttattttcattaaagatttttaattttaattattctttttcagggcgtatgtatatattcttgatcttaaaggctaagatggtatcatagataaaggataaatataaataatattcatatatgatttgcacttatcgccgctctcgtcctttgggcgggagctttttgacattctgattaggaggtttcaagatgccgcaagaaaacaatacattttacattacaacaccgatttattatccgagcggaaaattacatatcggccatgcatatacgacagtcgcgggagatgcaatggcacgttacaaaagattaaaagggttcgatgttcgctatttaacgggaacggacgagcatggacaaaagatccagcaaaaagctgaacaggaaaacattacacctcaggagtatgtggatcgcgcagcggcagatattcaaaaactgtggaagcagcttgaaatctcaaacgacgactttatccgcacgacagaaaaacggcataaagttgtcattgaaaaagtgtttcaaaagcttcttgataacggggacatctatcttgatgagtatgaaggctggtacagcatccctgatgaaacgttctacacggaaactcagctcgttgatattgagcggaatgaaaagggagaggtcatcggcggaaaaagccctgacagcggtcacccagttgaattgatcaaagaggaatcttatttcttccgcatggggaaatacgcggatcgtcttctgaaatactatgaagaaaacccgacattcattcagccagaatcacgcaaaaacgaaatgattaataactttatcaaacctggacttgaggatttggcagtatcacgtaccacttttgattggggcgtgaaggtgccggaaaatccaaagcatgttgtatatgtttggattgacgcactatttaactatttaacggcactcggttatgatacagaaaatgatgagctttatcaaaaatattggcctgccgatgttcatttagtcggtaaggagattgtacgattccatactatttactggccaattatgctgatggcgctggatcttccgctgccaaagcaagtattcgcgcatggctggcttttgatgaaagacggaaaaatgtcgaaatcaaaaggaaacgttgtagatccggttacattaattgaacgctatggtttagacgaacttcgctattacttgcttcgcgaagtgccgttcggatcagacggtgttttcacgccggaaggatttgttgagcgaatcaactatgatttagcgaatgatttaggaaatctattgaatcgtactgttgcgatgattaataagtattttgacggacaaatcggttcttacaaaggtgctgttacggaatttgaccatacgctcacttctgttgctgaagaaacagtgaaagcttatgagaaagcaatggaaaatatggagttctcggtagcactttcgactttatggcagctcatcagccgcacaaacaaatacattgatgagacagctccatgggtgcttgcgaaagatccggcaaaagaagaagaattgcgatcagttatgtatcatctcgctgaatcattgcgtatttcagcggtactgcttcagccattcttaacaaaaacacctgaaaaaatgttcgagcagctgggcattactgatgaatctttaaaagcttgggacagcattacagctttcggccagctgaaagatacaaaagtacaaaaaggcgagccattgttccctcgtttagaggcagaagaagaaattgcttacatcaaagggaaaatgcaaggttcagcaccagcgaaagaagaaacaaaagaagaagagcctcaagaggtcgatcgtttacctgaaattacgattgatcaatttatggatgtagagcttcgcgtagctgaggtcattgaggcagagccagtgaaaaaagcagaccgtttattgaagctgcagcttgatcttggttttgaaaagcgccaagtggtatccggcattgcgaagcattatacgcctgaagagcttgttggaaaaaaactcgtttgtgtaacaaatctaaaaccggttaaactcagaggagagctttctcaaggtatgatccttgcaggagaagcagacggcgttttaaaggtcgtgtctatcgatcagtcgttaccaaaaggcacaagaattaaataatgataaaacaaaaggtgtttcacgtgtaacaattcgtcgaacaccttttgtgtttcgacaagaaaggagtttttcacttatgttgtttgacacacacgcgcatttaaatgcagaacaatatgatactgatcttgaagaggttattgaacgggcaaaagctgaaaaagttgaacgaattgtcgtagttggttttgaccgtccgacgattacccgtgcgatggaaatgattgaggaatatgattttatttatgcagccattggctggcaccctgttgacgctattgacatgacagaggaagacttagcgtggattaaagagctttctgctcatgagaaagtggtagcgataggggaaatgggactggattatcattgggataaatcacctaaagatattcaaaaagaggtgtttagaaaacaaatcgccttagcgaaagaggtcaatttgcctattatcattcataaccgtgatgcaacggaggatgtcgtgaccattttgaaagaggaaggcgcagaagctgtgggcggaatcatgcactgctttacaggaagtgcggaagtggcaagagaatgcatgaaaatgaatttttatttatcatttgggggaccggtgacatttaaaaatgcgaagaaaccgaaggaagtagtgaaggaaattcccaatgaccggctgctgattgaaacggactgcccgtttctcacaccgcaccctttccgcgggaaaagaaatgagccaagctatgtgaaatatgtggcagaacaaatcgccgaattaaaagaaatgacctttgaagagattgcgtcaatcacgactgaaaatgcgaaaagacttttccgtataaactgacaaaaaacgctagcgggttttgtaagagcttgtcccttacagcgtttttctataaaagttctacatgctttcttctcctcataggataggtttgtcgacaagtctttcttccgtttctcagtgtatttcaggataatgaagaagacactgagcttttgggagaaagagaagggagggttgacagccttttagatactctatataatctctccgaggagaaggaggcgtttttcatcacacaaaaaatgaaaaagctgttttccgtaaagcttagcaaaagcaaagtcattctggttgctgcttgtttgcttttggcaggaagcgggactgcgtacgcggctcatgagctgacgaaacaatcagtctcagtttctatcaatggcaaaaagaaacatatacgcacacatgcaaatacagtcggtgatcttttggagacgcttgatataaagataagagacgaagacaagatcacacctgctaaacagacaaagataacagcagacatggacgttgtgtatgaggctgcaaaacctgtgaagcttacaataaacggggaagaaaagacattatggtcaacagcaaaaacggtcggtgcattactggacgaacaagatgttgatgtgaaagaacaagatcaaattgatcccgcaatagatacagatatttcgaaagacatgaagattaacatagagcccgcatttcaggttactgtgaatgatgcagggaaacaaaagaagatctggacgacttcgactacggtcgctgactttttaaaacagcaaaagatgaacataaaagacgaagataaaatcaagcctgcgttagatgcaaagctgacgaaaggaaaggctgatattataattactcgtatcgaaaaggtcaccgatgtagttgaagagaagattgcgttcgatgtgaaaaagcaagaagacgcttctcttgaaaaagggaaagaaaaggtcgtccaaaaaggaaaagaaggcaagctaaaaaaacatttcgaagtcgttaaagaaaacggtaaagaagtgtccagagagcttgtgaaagaagaaacagctgaacaaagcaaagataaagtgattgctgtcggcacaaagcaaagcagtccaaaagttgaaacggtcagtgcttcaggtgattcaaaaacagttgtgtcccgcagcaatgaatcaacaggcaaagtcatgactgtatcatctacggcttatacggcaagctgcagcggttgttcaggacatacagcgacaggcgtcaatttaaaaaataatccgaatgccaaagtcatcgctgtggatccaaatgtcattccgctaggctccaaagtccacgtggaaggctatggatatgctattgctgcagataccggttcagcgattaaagggaacaagatagacgtctttttcccagagaaatcatcggcgtaccgatggggaaataaaacagtcaaaattaaaatcttaaattagtatatacttatgtattcagagggttttgcgccctctgtttttttcgttataatagacaaagtgcattttctgcttattagacgctcgacataagaaaaagtttcatgaatatacaaaagtttttattttgtcttggaggaaataatgaaaattaaagagatcattgtggtcgaggggcgtgatgatacggcccgcatcaaattggctgttgatgcagacacaattgaaacaaatggttcagccatcgatgatcatgtgattgaccaaatccgtttggcccagaagaccagaggcgtcattgttttaacggatccggactttccgggagagaagattcgcaaaaccatctcagaggctgtgcccggctgtaagcatgcatttttgccaaaacatcttgccaaacctaaaaacaagcggggaattggtgtggagcatgcatcggttgaaagcattagggcatgtttagaaaatgtgcatgaggagatggaagcgcagccgagtgacatttcagctgaggatttgattcatgccggactaataggcggacctgcggccaaacgccgccgggaacgactgggtgatctgttgaaaatcggctatacaaatggcaaacagcttcaaaaacggctgcaaatgtttcaaattaaaaaaagtgattttatgagtgcgctcgataccgttatgcgggaggaacagaatgaataaagatattgcgacaccgattagaacgaaagagatactgaagaaatacggtttttcttttaaaaagagcttaggacagaatttcttaattgatacgaacattttaaacagaattgttgatcacgcggaagtgactgagaaaacaggtgtcattgaaatcggcccgggaatcggggctttaaccgaacagcttgccaagcgggcgaaaaaggtcgtggcatttgagattgatcagcgattattgccgattctgaaggatacactgtcaccttacgacaatgtcactgttattcatcatgacgtgttaaaggctgatgtcaaatcggtcattgaagaacaatttcaagattgcgatgagatcatggtagttgccaaccttccttattacgtaacaacaccgattatcatgaaactgcttgaagaacatcttccgctgaaagggattgtggtcatgctgcaaaaagaagtggctgagcgcatggcggctgatccttcatctaaggaatacggctcgctttcaatcgcggtgcagttttatacagaagccaaaacggtgatgatcgttccgaaaaccgtatttgttcctcagcctaatgtcgattccgcagtcatccgtctgattctccgagacggcccggcagtggacgtggaaaacgaatcctttttctttcagctcatcaaggcaagctttgcacagcgccgtaaaacgctgctcaataacttagttaacaatctgcctgaaggaaaagcgcaaaaatcaacgattgaacaagtgctcgaagaaacaaatattgacggtaagcgccgaggtgaatccctgtctattgaggagttcgcagcgctgtctaacggattgtataaagcccttttctaaaagggctttttgttttgcgcaccacatggactgccgctacataggctagagaaggacctttcattcaatgataagaaaaacttggactcagcgaaaaaaggcgctttctcaaggctctttctttcatgatgaggcttagtctatgtgtggagtgaggaacgtgcaatttcaaataggggatatggtagccagaaaatcctatcagatggatgttttgtttcgaattataggaatagagcaaacaagcaaaggaaattcaattgccattttgcatggagatgaagtcaggctgattgctgattcggatttttctgatctggtggcagtgaaaaaggatgagcagatgatgcggaaaaagaaagatgagagcagaatgaatgagtcgctcgaattactccgccaagattataagctgctcagagaaaagcaggagtactatgcgacaagccaatatcagcatcaggagcattatttccatatgccgggcaaagtgcttcatctggatggtgacgaagcatatctgaaaaaatgcctgaatgtctataaaaaaattggagtgccggtctatggcatccattgccatgaaaagaaaatgtctgcttctattgaagaattgctcgacaaatatcgacctgatatcctggtgatcacagggcatgatgcgtattcgaagcaaaagggcggcattgatgatttgaatgcgtacagacattctaagcactttgttgaaactgttcaaacagcccgaaaaaagatccctcacttagatcagcttgttatttttgcgggggcctgccaatcccattttgaatcactcatcagagcgggtgcgaattttgcaagttcaccgtcaagagtcaatattcatgcgcttgatccggtatatatcgtcgcgaagatcagctttacgccgtttatggaacggattaatgtatgggaagtgctccgtaatacgctgacaagagagaaagggcttggaggtattgaaacaagaggagttctgagaattggtatgccttataagtccaattaacagttgaaaacctgcataggagagctatgcgggttttttattttacataatgatacataatttaccgaaacttgcggaacataattgaggaatcatagaattttgtcaaaataattttattgacaacgtcttattaacgttgatataatttaaattttatttgacaaaaatgggctcgtgttgtacaataaatgtagtgaggtggatgcaatggcgaagacgttgtccgatattaaaagatcgcttgatgggaatttaggtaaaaggctgacgttaaaagcgaacggtggccgccgaaaaacgattgagcgttcgggcattttagctgagacgtacccttctgtttttgtgatacaactagatcaagacgagaactcgtttgaaagagtttcatacagttatgctgatattttgactgagactgttgagctgacatttaatgatgacgccgcaagctcagtggcattttaacgggcagtgaaccttttgtttactgctttttgttttgcccttttttggtttccagtaatttaaacgaaagttccttctgatttaacaaaagataaaacagtcacatattatcgtgacgtgcacgaatggctatcacttctaaaaaaggggttgtttcgtttgggcagacgtcgtggagttatgtcagatgagtttaaatatgagcttgctaaagaccttggtttttatgacacagtaaaaaatggcggctggggcgaaattcgggctcgcgatgccggtaacatggtaaagcgcgctatagaaatcgccgaacagcaaatggctcagaatcagaataaccgataaggatgtgacccgggggacgtgctgttccctggtttttttattttggatataaatacataatgggctgaatatggatatgttcatcctgtacttcaaatgtgatacaatgttcatacttatgtttagatggagaagtaggtgaaagctatgcgtattttagaaaaagcgccagctaagatcaatctgtcacttgacgtcacccgaaaacgcccggatggctatcatgaagtcgaaatgatcatgacgacaattgatttagctgatcgaattgaattgacggagcttgcagaggatgaagtgagggtttcctcccacaaccgatttgtgcctgatgaccaaagaaacttagcttatcaggctgccaagctgatcaaggacagatacaacgtgaaaaagggagtttccatcatgattacgaaggtaattccggtggctgccggtcttgccggcggaagcagtgatgcggcggcgacactcagagggctgaacagactgtggaatttaaatctgtctgcggaaacgcttgctgagcttggagcggaaattggctctgacgtttcattttgtgtctatggcggaactgcattagcaacagggcgcggcgagaaaattaaacatatcagcacgcctccgcactgctgggtcattttagcgaagccgacaatcggtgtttcaactgctgaagtgtacagagcgttgaaactggatggtatagagcatcccgatgtacaaggcatgatcgaggcgatagaagaaaagagttttcagaagatgtgcagccggttaggcaatgtgcttgaatctgttacactcgatatgcatcctgaagttgcgatgatcaaaaaccagatgaaacgctttggtgcagatgccgtgttaatgagcgggagcggcccgacagtatttggactggttcagtatgagtcgaaggtgcagagaatttataacgggttaagaggcttctgcgatcaagtttatgcggtgagaatgatcggcgaacagaacgctcttgattaaatccgtatgttaagttatattgatcttaaaatattcggattttgggggtaagttcatgaagtttcgtcgcagcggcagattggtggacttaacaaattatttgttaacccatccgcacgagttaataccgctaacctttttctctgagcggtatgaatctgcaaaatcatcgatcagtgaagatttaacaattattaaacaaacctttgaacagcaggggattggtactttgcttactgttcccggagctgccggaggcgttaaatatattccgaaaatgaagcaggctgaagctgaagagtttgtgcagacacttggacagtcgctggcaaatcctgagcgtatccttccgggcggttatgtatatttaacggatatcttaggaaagccatctgtactctccaaggtagggaagctgtttgcttccgtgtttgcagagcgcgaaattgatgttgtcatgaccgttgccacgaaaggcatccctcttgcgtatgcagctgcaagctatttgaatgtgcctgttgtgatcgttcgtaaagacaataaggtaacagagggctccacagtcagcattaattatgtttcaggctcctcaaaccgcattcaaacaatgtcacttgcgaaaagaagcatgaaaacgggttcaaacgtactcattattgatgactttatgaaagcaggcggcaccattaatggtatgattaacctgttggatgagtttaacgcaaatgtggcgggaatcggcgtcttagttgaagccgaaggagtagatgaacgtcttgttgacgaatatatgtcacttcttactctttcaaccatcaacatgaaagagaagtccattgaaattcagaatggcaattttctgcgtttttttaaagacaatcttttaaagaatggagagacagaatcatgacaaaagcagtccacacaaaacatgccccagcggcaatcgggccttattcacaagggattatcgtcaacaatatgttttacagctcaggtcaaatccctttgactccttcaggcgaaatggtgaacggcgatattaaggagcagactcatcaagtattcagcaatttaaaggcggttctggaagaagcgggtgcttcttttgaaacagttgtaaaagcaactgtatttatcgcggatatggaacagtttgcggaagtaaacgaagtgtacggacaatactttgacactcacaaaccggcgagatcttgtgttgaagtcgcgagactcccgaaggatgcgttagtcgagattgaagttattgcactggtgaaataataagaaaagtgattctgggagagcccgggatcacttttttatttaccttatgcccgaaatgaaagctttatgacctaattgtgtaactatatcctattttttcaaaaaatattttaaaaacgagcaggatttcagaaaaaatcgtggaattgatacactaatgcttttatatagggaaaaggtggtgaactactgtggaagttactgacgtaagattacgccgcgtgaataccgatggtcgcatgagagcgattgcatccatcacgctggatcacgaatttgttgtacatgatattcgtgtgattgatggaaacaatggtcttttcgttgcgatgccgagtaaacgcacccctgatggagagttccgcgatattgctcatcctattaattcaagcacgcgaggaaagattcaagatgccgtgttaaatgagtatcatcgtctgggtgacactgaagcattagaattcgaagaagctggagcttcttaaaaaataaccaaaaagcaaggactgctgaaagggctgacataagccttttgccggcggtccttttttaattctgatttttcaaacttagttgcactcaatagaaaattcttgcacttcatgaagtctccttgaaatcagaagatatttaggatatatttttctatggataaaagggatattggaggccaataaatggataagcggtttgcagttgttttagcggctggacaaggaacgagaatgaaatcgaagctttataaagtccttcatccagtttgcggtaagcctatggtagagcacgtcgtggacgaagccttaaaattatctttatcaaagcttgtcacgattgtcggacatggtgcggaagaagtgaaaaagcagcttggtgataaaagcgagtacgcgcttcaagcagaacagcttggcactgctcatgctgtaaaacaggcacagccatttcttgctgacgaaaaaggcgtcacaattgtcatttgcggagatacgccgcttttgacagcagagacgatggaacagatgctgaaagaacatacacaaagagaagcgaaagctacgattttaactgcggttgcagaagatccaaccggatacggccgcattattcgcagcgaaaacggagcggttcaaaaaatcgttgagcataaggacgcctctgaagaagaacgtcttgtaactgagatcaacaccggtacgtattgttttgacaatgaagcgctatttcgggctattgatcaggtgtctaatgataatgcccaaggcgagtattatttgccggatgtcatagagattcttaaaaatgaaggcgaaactgttgccgcttaccagactggtaatttccaagaaacgctcggagttaatgatagagttgctctttctcaggcagaacaatttatgaaagagcgcattaataaacggcatatgcaaaatggcgtgacgttgatcgacccgatgaatacgtatatttctcctgacgctgttatcggaagcgatactgtgatttaccctggaactgtgattaaaggtgaggtgcaaatcggagaagatacgattattggccctcatacggagattatgaatagtgccattggcagccgtacggttattaaacaatcggtagtcaatcacagtaaagtggggaatgatgtaaacataggaccttttgctcacatcagacctgattctgtcatcgggaatgaagtgaagatcgggaattttgtagaaattaaaaagactcaattcggagaccgaagcaaggcatctcatctaagctatgtcggcgatgctgaggtaggcactgatgtaaacctgggctgcggttcaattactgtcaattatgatggaaagaataagtatttgacaaaaattgaagatggcgcgtttatcggctgcaattccaacttggttgcccctgtcacagtcggagaaggcgcttatgtggcggcaggttcaactgttacggaagatgtacctggaaaagcacttgctattgccagagcgagacaagtaaataaagacgattatgtgaaaaatattcataaaaaataatcctaaattcggaggtttatccatgtctaatcaatacggagataagaatttaaagattttttctttgaattcgaatccagagcttgcaaaagaaatcgcagatatagttggagttcaattagggaaatgttctgtcacaagatttagtgacggggaagtccaaattaatatcgaagaaagtattcgcggatgtgattgttacatcatccagtctacaagtgaccccgttaacgagcatattatggaactgctgattatggtagatgcgttaaaacgcgcttctgcaaaaacgattaacattgttattccttattacggttatgcgcgtcaagacagaaaagcaagatcccgtgagccaatcacagctaaacttttcgctaacctgcttgaaacagccggtgcgactcgtgtgattgcacttgacctgcatgcgccgcaaattcaaggattctttgatataccgattgaccacttaatgggtgttccgattttaggagaatattttgaaggcaaaaatcttgaagatatcgtcattgtttcaccagaccatggcggtgtgacacgtgcccgcaaactggctgaccgactaaaagcgccaattgcgattatcgataaacgccgtccgcgtccaaacgtggcggaagtcatgaatattgtaggtaacatcgaagggaagactgctatcctcatcgatgacattattgatactgcaggtacgattacacttgctgctaatgcgctcgttgaaaacggagcgaaagaagtatatgcatgctgtacacaccctgtactatcaggccctgcggtagaacggattaataattcaacaattaaagagcttgttgtgacaaacagcatcaagcttcctgaagaaaagaaaattgaacgctttaagcagctttcagtcggaccgcttctggccgaagcaattattcgcgttcatgagcagcaatcagtcagctatctgttcagctaaaccatttttcgaggtttaaatccttatcgttatgggtattgtttgtaataggacaactaaaacgacaataggatggtgctgaatatggcaactttaacggcaaaagaaagaacggactttactcgttcgtctcttcggaatatccgtacttcaggacatgttccaggtatcatatatgggaaggatacgggtaacaaacctgtgtcattagacagtgtggagctcatcaaaacgctgagggacgaaggcaaaaatgcagtcattacgcttgaggtcagcggagaaaaacactcagtcatggtaacagacctgcagacggacccgctgaaaaatgaaatcactcatgctgattttcaagtagttaatatgagtgaggacattgaagtggaagttccgattcatctgaccggagaagccattggagtgaaaaacggaggcgtactgcagcagccgttatatgcacttactgtaaaggccaagccaaaagccattccgcaaacgattgaggctgatatttcaagcctcgatgtaaatgaagtactgacgattgcggatttgcctgctggcggtgactactcctttaatcatgaatcagatgaggttgtggcttcaatccttcctccgcagcagcaggaagcagctgaggtcgatgaagaggaatctgccgatgctcagccagaaggtgaaaacgaacaataatagcttaaggcgtaaccctcccgcggttacgtcttttgtgctagaatgagaagaattatagcccgattatgaagacgggagttatgtgactaagggaggattcgccatgcttgtgattgccggtctcggaaacccggggaagaactatgaaaatacacggcataatgtcggatttatggtgatagatcagcttgcaaaggaatggaatatagagctgaatcaaaataaatttaacggattatacggaaccggatttgtttccggcaaaaaggttctacttgttaaaccgcttacatatatgaatttatcaggagaatgtttgcggcctttaatggactactatgatgtcgataacgaagatttgacagtcatttacgacgaccttgaccttccgactggcaagatccgtttaagaacgaaaggaagcgccggagggcacaatggcatcaaatcactgatccagcatcttggaacatccgagtttgaccgtatccgcatcggaatcggccggcctgtaaacggcatgaaggtcgttgattatgtgttaggctcctttaccaaggaggaggcacctgagatcgaagaagcggttgataaatctgtgaaggcttgtgaggcttctttgagtaaaccgtttttagaagtcatgaacgaatttaacgcaaaggtataaaatgtaacaacaaagtccatactacaccaaaatgactttttcatcaggaggtcccttgtatggctttgcattattattgtcgtcattgcggagtgaaagtaggcagtctcgaatcttcaatggtatcgacagactcacttggatttcagcacttaacaaatgaggaaagaaacgatatgatttcttataaagaaaatggagatgtccatgttttgacgatatgtgaagattgccaagaggcgcttgaccgaaatccgcattaccacgaatatcacacatttattcaataaaaagctttggtgtagacactagaccaaagcgtttttctgttctcgcaggaaacagagaggaggggccatatggacaacattcaaacctttataaaagaaagcgatgactttaaatccatcatcaacggtttacacgagggcctgaaggaacagctgctcgcgggtctgtcgggttccgcgcgttctgtttttacttctgctctggctaatgaaacgaataagcctatctttctcatcacccataacttatatcaagcccagaaagtaacagatgatctgacttcacttctagaggatcggtctgtccttttgtaccccgtcaatgaactcatttcatcagaaatcgcagttgcaagccctgaattgcgggcgcagcgattagatgtcattaatagactaacgaatggagaagcgccaattgtcgttgctccggtagcggcaatcagaagaatgctgccgcctgttgaggtgtggaaaagcagccagatgctcattcaagtaggccatgatatcgaacctgaccagcttgcctcacggctgatagaggtagggtatgagcggtctgatatggtttctgcgcccggggaattcagtattcgcgggggaatcattgacatttatccgttgacttcagagaatccggtgagaattgaactttttgacaccgaggtggattcaatccgcagctttaattcagatgatcagcggtcaattgagacccttacctcgatcaatatcggtcccgcgaaggaattaattatcagaccggaagaaaaagcgcgggcgatggagaaaatcgatagtggtcttgccgcgagcttgaaaaaattaaaggctgacaaacaaaaagaaatacttcatgcgaatatttctcacgataaagaacgcttgtctgaaggccagacagatcaggagctcgtgaagtatctctcatatttctatgaaaagcctgctagtttactagattatacacctgataatacacttctgattttggatgaagtcagtcgaattcatgagatggaagaacagcttcaaaaagaagaagcggagtttatcacaaatcttcttgaggaagggaagattttgcatgacattcgtttgtcattcagcttccaaaaaatagtggctgagcaaaaacggcctctgctgtactactctttatttttgcggcatgtacaccatacgagcccgcaaaacatcgtcaatgtgtcaggccggcaaatgcagagtttccatggccaaatgaacgtgcttgcgggcgaaatggagcgttttaaaaaatcaaatttcactgttgtgttcttaggagcaaacaaggaacgtacacagaaattgtcatctgttttggctgattatgatatcgaggccgccgtgacagacagcaaaaaagcgcttgctcagggacaggtctatatcatggaaggcgagctccaatcgggatttgagctgccgttaatgaagcttgccgttattacggaagaagaactgttcaaaaaccgtgtgaaaaagaagccgcgaaaacagaagcttaccaatgcagagcgcatcaaaagctattctgagcttcaaattggagattatgtcgttcatattaatcacgggatcggaaaatacctggggatcgaaactcttgaaatcaacggcattcataaagactatttaaatatacattatcagggcagtgacaagctttacgtccctgtagaacaaattgatcaggtccaaaaatatgtcggctccgaaggaaaagagccaaagctgtataaattaggcggaagtgaatggaagcgggtcaagaaaaaagtagagacatccgttcaggatattgctgatgacttaattaagctgtatgccgaaagagaagcgagcaagggctatgcgttttctcctgaccatgagatgcagcgtgaattcgaatcggctttcccttatcaagagactgaggatcagctccgttctattcacgaaatcaaaaaagacatggaaagagaacgtccgatggaccgcttgctgtgcggagatgtgggctacggtaaaacagaggttgccatacgtgccgcgtttaaggcgatcggtgacggaaagcaggtagctctgctcgttccgacaacaattttggcacagcagcattatgaaaccataaaagagcgcttccaggactatccgattaatatcggacttctcagcaggttcagaacgagaaaagaagcaaacgaaacaatcaaagggctgaaaaacggaacagttgatatcgtcatcgggacgcatcggctgctatcaaaggatgtcgtgtataaagatttagggctcctcatcattgatgaagagcagcgtttcggtgtaacccataaagaaaagatcaagcaaataaaagccaatgttgatgtattaacgttaacagcaacaccgattccgcgtacgctgcatatgtctatgcttggcgtaagggacctttcagtcatcgagactccgccggaaaatcgcttccctgtacagacgtatgttgtggaatataacggcgctcttgtcagagaggcgattgaacgtgagcttgcacgcggaggccaggtctatttcttgtacaaccgggtagaggacattgagcggaaagcggatgaaatttcaatgctagtccctgacgcgaaggtagcatatgcgcatgggaaaatgacagaaaatgaattagaaaccgttatgctaagtttccttgaaggagaatcagacgttctcgtcagcacaaccattatcgaaactggcgtggacatcccgaacgtcaatacgctgatcgtatttgacgccgacaagatgggactttctcagctttaccagctgcgggggcgtgtcggtcgttctaaccgtgtggcgtatgcgtacttcacgtatcgccgggataaagtgctgacagaagtggctgaaaaaaggctgcaggccattaaagaattcacagagctaggttccggttttaaaatcgcaatgcgtgacttaacgattcgcggagccgggaatcttcttggtgcccagcagcatggcttcatcgattcggtcggatttgacctctattcacaaatgctaaaggaggccattgaggagcgtaaaggagacacagcgaagacagagcagtttgaaacagaaattgatgtcgagcttgatgcgtatattccggaaacttatgttcaagacggcaaacagaaaattgatatgtataaacgcttcaggtctgtggcgacaatcgaagagaagaatgagcttcaagatgaaatgatcgaccgctttggaaactatccaaaagaagtcgaatacttgtttactgttgcagaaatgaaagtctatgcgagacaggaacgtgtcgagctgattaagcaggataaagatgctgtcagattgacgatttctgaagaagcaagtgctgaaattgacgggcagaagctgtttgagcttggcaatcaatatggcagacaaatcggactgggaatggaagggaaaaaactcaaaatctccatacagacgaaaggccgtagtgctgatgaatggctcgacaccgtgctgggcatgctgaagggcttaaaagatgtgaagaagcaaaccatttcatcaacgtaaattttgttactctctggtgtatattacatttgatgtgacggatactaatttcaagcgaggcggaaggtacataaagtaactgctttaggtctttcccacatgtatataccatcaaatgaaagagaggcaccagagatgaaagcaaccggtatcgtacgtcgtattgatgacttaggtcgggtcgtgattcctaaagaaattcgaagaactctgagaatcagggaaggcgatccgcttgagatttttgtagatcgtgacggagaagtgattttgaaaaagtactctccgatcagtgagcttggagactttgcaaaggagtatgcagacgcgctttacgacagcctcggccattcagtgctgatttgtgatcgtgatgtatatattgccgtgtccggcagctccaaaaaagattacttaaacaagtcaatcagcgaaatgctggaaagaacaatggatcagcgcagctccgtgcttgagagtgatgcgaaatcagtacagcttgtgaatggaattgatgaggacatgaattcttatactgtcggcccaattgtggcgaacggtgatccgataggtgctgtggtgattttttcaaaagatcagacaatgggcgaagtagagcataaagccgttgaaacagcagctggatttttggctcgtcaaatggaacagtaggtcttattcctttcttcgaaaataggtatgtaaagaacagctctccttgggacgctgttctttttcatgcgtgcggaaaaaggaatccaagggttgggatgtggtataataacctcgtttttatttgtgccgcggtaatacgtgaaccgtattgcccctgacgttgggaaggagcttttggatggacgattcaataggcgttaaacggcattggatttggcagggggcttttgttttaattctggcaggcgtcattacaaaaattttaagcgctgtttacagagtcccgtttcaaaacattgtcggcgatgttggattttatatatatcagcaggtatacccctttcttggtattgcggtcatgctgtccacatcaggatttccagtcattatttcaaagctgatgaatgattatagtgaaaaaaatcatcacaccatattaaaaatatcagcgttatttttgtctttaatcggtattttattatttctttgtttatatctgggtgctgttcctattgcactctttatgggggattcgcatctagccgtgttaattcaagtggccgcgtacgcgtttctgctgttcccatttgtcgcgttgcttagaggcggttttcaggggcggaacgaaatgctcccttcagccttatcacagatgacagagcagtttctgcgtgttgcagtgctcttgggtttatcattttggctcgtgaaaaagggagcctcgctttatactgcgggagcggcagccgcttcaggctctcttgccggaagtttggttgcattgataatactggggtttttttggttcaaaacgaaaagagacaaccaaacggataggcaaaacgaaaatgtcatcacaacaaaagaattgacgaaaaaactgcttttatattcggttacaatttgtgtaagcagtttgctgcttttgtttatccagcttgttgatgctttgaatttatatgcattgctttcgggtggtgaggcaagcgaagaagcaaaacgcctaaaggggatctatgatcggggacaacccttgctgcagctcggttcagtttttgccgtaagcattgcgacgtcactcgttccgtatatttctatggctgtaaaaaacaaagagctgaagatcatgaaagaaaaaatcacgtcatctttgaaactatgccttgtgctcggtacaggcgcatcggctgggttgatttgcattctaaagccggtaaatatcatgctgtttcaaaatggagaagggacaggtgcgttacaagtatttagctgctccattttgtttgtatccttggcggtaacggcagcggcagtcttacagggagcgggatacacagtttttcctgcgatagcggtgggcgcgggtgttgcagtgaaatgggtgttaaacacacttttggttccgcgctatgggattgaaggcgcatcgcttgcgacagcggcttcctttgcggctgtcgccggcctcaacttgtatcagcttcggcaaaaggaatggctcgataagcttagaggcgttttgattccgattattggatctgctcttttgatgtcagctgtcttgcttgcgtatatgcgtttctggaattttttgtttccagctacaggaagaggagttgctgtgattgagagtctttctgctgttgccattggtggcgcgatgtttatttattgtatgatgagattgggaatatttacagatgaagagctgaacagtgtgccattcggcagcaagttaagcaaattcatgagaaggagagaacaaaatggcgggtaaaattacagtcgtgggacttggtgccggagacatggaccagttgacaattggtatacacaagctgctgacgaaggcagatacgctgtatgtcagaaccaaggatcatcctttaattgaggagcttgaaaaagaaacgaagaacatccgtttctttgatgatatatatgagaaacatgatcagttcgaggcggtatatgaagaaattgctgatatcctctttgaagcggcgcggcgtgaggacgtggtttatgctgtgccgggacacccttttgtcgcagaaaaaacagttcagctgctgacggagcggcaggaaaaggaaaacgttcaagtgaaagtcgcgggtggacaaagtttccttgatgccacattcaatgccttgcaaattgacccgattgaaggttttcaatttgtggatgccggcacattgtctgcggatgagcttgagctcagacatcatctgatcatatgtcaggtttacgaccaaatgacggcttctgaagtcaagctgacattgatggagaagctgcctgatgattatgaggtcgtcattgtgactgcagcaggcagccgtggcgaggagatcaagacagtgccattatttgagctggaccgcaatgtcgccttgaacaacttaacaagtgtgtatattccgccgattaaagaagagaagctgctttatcacgaattctccacgttccgaagcatcatcagagagcttcgcggacctaatggatgtccgtgggataaaaagcagacgcatcagtcattaaaacagtacatgattgaagaatgttatgagcttctcgaagctattgacgaagaagacacagaccatatgatcgaagagcttggcgacgttttgcttcaggtcttgcttcacgcgcaaattggtgaagatgaaggttatttcacaattgatgatgtcataaaaggaatcagtgaaaaaatggtccgaagacatccccatgtgtttaaagatgttaaggttcaggatgaaaacgatgttttggccaattgggaagatataaaaaaggccgaaaaaaatacatctgaatcatcgttactagacagcgtaccgaaaacccttccagctctttcgaaagctgctaaattgcagaaaaaagcagcgaaggtcggttttgactgggaagacgtcagcgatatttgggagaaggtaagtgaggaaatgaaggaattttcttctgaggtttctgaagctcctcacgaacacaatcttaaagctgagtttggcgacattttgttcgcgctggtgaatgtagcccgcttctacaaaatagagccagaggaagcgctggccatgactaatgacaaattccggagacggttctcgtacattgaggaaacagcgaaggaagagggagtcgagttggctgatatgtcccttgaggacatggacaaactgtggaatgaagcaaaagaaactgagaggagatcatagatatgagattagataaatttttgaaagtatcacggctgatcaaacggcgtacactagcgaaggaagtagctgaccaaggacgaatctctattaacggaaaccaagctaaagcaagctctgacgtaaaaccgggagatgaactaacggtccgcttcggccaaaagcttgtaacggttcaagttaatgaattgaaagacacgacgaaaaaagaagaagctgcaaacatgtacacgattctaaaagaagaaaaactcggcgaataggcttgttctaaaaaaatcccctacctcatacaatgcagtaataatgctaaaagtatcgaggatatgggggctgaatagatgaattcatattatgatcaaaaaggttcttcgtctgttccggaacaacatgatgtgacaatgaaaggccggaagcatttagatatttctggggttaagcatgtggagagttttgataacgaagaattcctgctggaaacggtgatgggaatgctctccgtcagaggccaaaacctgcagatgaaaaatcttgatgtggaaaaagggattgtttcgattaaaggcagggtatttgatttagtgtacttagacgaacaacaaggggataaagctaaaggattttttagcaagttgtttaaatgacgctgacgacacaattctatacaatgctggcgatgtccggtatgggtctctggcttggtgcttcgcttgatacataccggctctttgtcattcgtgccaaaacagccagatggctattatttattcatgatatacttttctggattgtgcaaggactgcttttcttttatgtcttgcttcatgtaaatgagggagaattcaggatttacatctttttagcggttctgctgggcgttgcgacgtatcagagcctttgcaaacgaatctatataaaaatactgaaattcttcatttaccttgttgtttctgtttatcaattcttcaaaaaactcattcagcacgtgttatttcgtcctattgtatggacatgcggagcgatcatctggctggcggcatttttattcaagaaaacatacagcctgataggttttctcctgctgtgtctatataaaatagtcatggttctgtgttttccgatccgttttatcgcgaaacaatgtttgaaacttcttcctgtgaaaatgcgtctaacttttagacgttattttgaaaaaggtgcaggatttctcaaaaagaagaagaaactattgataaccataagaacgaccattacacggtttttgaagaaatgaaaggaggaccgtctggtttgaatttttccagggaacgaacgataactgaaatacaaaacgactataaagaacaagtagaacggcaaaatcagctgaagaaacgaagacgcaaagggctgtacagacggttaactgtattcggcgccctagtattcctgacggcaattgtgctggcaagctctatctggtctcaaacatcttcccttagtgcaaaagaagaaaagaaagaacagcttgaaaaagaactgaaaagtttaaagacaaaacaaacggatttaaaagaagaaatatccaaattgaaggatgaggattacgtcacagagcttgctagaagggacttattcatgtctggagacggagaaattatcttcaatgtggagaagaagagcaagtagccttgttgacacttaaatttttatttaggtataattaagcaaacgatctttttataagcctaaggaggagcactttttttatgtcgattgaagttggcagcaagttgcaagggaaaattacaggtattacaaattttggagcatttgttgaattgcctggaggctcaaccggtctcgttcacattagtgaggtagctgataattatgtcaaagacattaacgaccacttaaaagtcggcgaccaagttgaagtgaaagtcatcaacgttgaaaaagacgggaaaattggtttatctattaaaaaagctaaagaccgtccgcaagccagacctagaaatgatttccgtccgaaagaatcttttgaacagaaaatgaataagtttttaaaagacagcgaagatcgcttgtcatctttaaaacgcaatacggaatcaaaacgtggagggcgcggagcaagaagaggataacttgctgctttctataaaataaatgaagcatccgttcatcccgacggatgcttttttattatcctcatcctctttaagagtcagaaaattacaacattaaagtttctgttgacgaaagagacaaacctttgtattatataacttgtgcttagaagcacaaaacaatatggcggtgtagctcagctggctagagcgtacggttcatacccgtgaggtcgggggttcgatcccctccgccgctaccatatttgtttggcccgttggtcaagcggttaagacaccgccctttcacggcggtaacacgggttcgaatcccgtacgggtcatcctaaaaaatcggtttctcttgcagaagccgatttttttcatttttagacaacattccggaaattcttttcataaacgaatatcaaggcagaaaccgtcgaagatttctttggtattgttaccttcttttgacaaaatcctatctgtgctttcgctataatgacaggcaacgaatataacaggtgggagatgagaggaatggaaaaagcagaaagaagagtgaacgggccaatggcgggacaagctttggaaaaactccaatcgttttttaacaggggcacgaagctggtgactcatcatttgcattcactgtttttctataaaggattcatttatgttgtcatcggatttttgcttggacgggctttcatattatccgaggtgcttcctttcgcacttcctttctttggagcgatgcttcttatcagaagagacaaagcgttttatgcggttttggctgtgcttgcaggtgcgctgaccatatctccaaagcactcattgctcatactggcggcattgctggcattcttcgtattttctaaagtggctgccttcattaccgacgatcgtgttaaagcgctcccgattgtcgtgttcttctcgatggctgcagcaagagccgggtttgtttatgcccaaaatggcgtatttacaacctatgattatgtaatggctatcgttgaggctggactatcgtttatcttaacactgattttccttcagagccttccgatttttactgtgaaaaaagtgaaacaatcattaaaaatagaggaaatcatttgctttatgattcttattgcctctgttttaacggggctggccggcttgtcctaccaagggatgcaggcagaacatatattggctcgttatgttgtattgagtttttcctttattggcggagcaagcatcggctgtacggttggtgttgtgaccggcctgattcttggcttggcgaatatcggaaacctatatcaaatgagtctgcttgctttttccggtttattgggcggtttgctgaaggaagggaaaaaagcgggtgcagcaattggtttgatcgttggatcacttcttatatctttatatggtgaaggctctgccggtctgatgacaacgctctatgagtcattaatcgcagtcggcctgtttttgctcacacctcaatctattacgaggaaagtggcgagatatattccgggaactgtcgagcatcttcaagagcaacagcaatacgctagaaaaatccgtgatgtcactgctcagaaggtagaccagttctccaatgtatttcacgcgctgtctgaaagctttgcaaccttttaccaagcgtcagacgaacagacagatgacagcgaagttgatctgttcttaagcaaaatcacggagcattcctgccagacgtgctacaagaaaaacaggtgctgggtacagaactttgataaaacatatgacttaatgaaacaagttatgcttgaaacagaggaaaaagaatatgcatcaaaccgaaggctgaaaaaagagtttcaacagtattgttctaaatccaagcaggttgaagagctgattgaggatgagctcgcacatcatcatgcccatttgacactcaagaaaaaagtccaagacagcaggcgccttgttgctgaacagcttttaggcgtttctgaggttatggccgacttttctcgggaaataaaaagagagcgagaacagcactttctgcaggaagagcaaatcatagaagcgcttcagcatttcggaattgagattcagcatgtcgagatctatagtcttgaacaaggaaatatcgatattgaaatgaccattccgttcagcggacatggagaaagtgaaaaaatcattgctcctatgctttctgacattctggaagaacaaattcttgtgaaagccgaacagcactctccgcatccgaatggatacagccatgtcgcctttggatcaacaaaatcatacagggtgtccacgggagctgctcacgctgcgaagggcggcggccttgtctccggtgacagctacagcatgatggagcttggagccagaaaatatgctgcagcaatcagtgacggaatgggcaatggcgcaagagcgcactttgaaagcaatgaaacgatcaagcttcttgaaaaaatccttgaatcgggcattgatgaaaaaatagcaattaaaacgatcaacagcatactgtctctaaggacaactgacgaaatatattccacgcttgacctatctattatcgatcttcaagatgccagttgtaaatttttgaaggttggatcgacgcctagctttatcaaacggggtgaccaggtcatgaaagttcaagcgagcaatctgccaatcggtattattaatgaatttgatgtggaggttgtgagtgaacagctgaaagcgggtgacctcttaattatgatgagtgatggcatttttgaggggcctaagcatgtggaaaatcacgacttatggatgaaacgtaaaatgaaagggttgaaaacaaatgacccgcaggagattgccgatttgcttatggaagaagtcatccgcacaagatccggccaaattgaggacgatatgactgttgttgttgtccggattgatcacaatacaccgaagtgggcatccattcctgttccggcaatctttcaaaacaaacaagaaatttcataacgcttccgtataaatcaaatttcttctggcgaagatgggaatatatgaatctgagaatcctcgtattctccaggaggaatgaatgtgaacaacggacatttaaatcaaattttgctgataacggatggctgctcaaaccatggggaagacccgcttgcaatggctgcttttgctaaagagcaggggattacggtaaatgtcattggtataatggaagaaaatcaaattgaccctgaggcaatgaaggaagtcgaagggattgcacttgccggaggaggcgtgcaccaagtcgtttatgcatctcagctttcacaaactgttcaaatggtaacaaaaaaagcgatgacgcaaaccttacaaggtgtagtcaatcaagaactgaaacagattctcggaaagaatgtggaaatggaagagctttctccggaaaaacgcggcgaagtcatggaagtggtagacgagcttggagaaacggtgcatcttcaggttttggttcttgttgatacaagtgcaagtatggcgccaaagcttccaacagtaaaagaggcgctgattgatttgtctgtaagcctcaattcccgaatcgggaataacgaatttgcgatgtgtatatttcccgggaaaaaacaagaggtcgagcttgtgctgaactggacaccgaagctgcaatctctttccacactctttgcaaagctttcgacaggcggcatcacgccgacaggtccggcgattcgtgaagcgacactgcagtttgaaaaaatacgctcaagaaggggcatgctggcagatgatgaacgacgctttgacgagtttggcatgtagcctcaagccgggtacgacaatcaaaggcaagtggaatggaaacacttatacattgcgtaaacagcttggtaaaggggccaatggaattgtgtatttggcagaagcatcagatggacatgttgccttaaaggtgagtgatgacagcctgtctattacttctgaagtgaatgtcttgaaatctttctcaaaggcccagtccgttacgatggggccttctttttttgatacggatgatgcctatattcccagtgccaatacgaaagtttcattttatgcaatggaatacataaaagggccgctgcttttgaagtatgtcagtgataaaggagcagagtggatacctgtattaatgattcagctgttatccagcttatcggtgcttcaccagcaaggatggatattcggcgatcttaaacctgataatctgatcgtaactggtccgcccgcaaggatccgctgcattgatgtgggcggcacgacaaaggaaggccgggcgataaaagagtatacggagttttatgacagaggctattgggggtatggaacaagaaaggcagagccatcctatgatctgttcgcagttgccatgattatgatcaacagtgtgcataaaaaagaatttaagaaaacgaaccagcccaaagaacagcttaggtctctcatcgaaggaaacccgctgcttcaaaagtataaaaaagcgcttttttcagccttgaacggagattatcaatccgcagatgaaatgaaaaaggatatgctagacgcggggcaaaaagcatcacaaaaaaaacagcctataaaagcatcaccgcagcctgccacacgacaaagacagcaaataccgcgccaaggaaaaataacgaagacgcgatataccccaaaacagaaaccggctaagtcgggggggttatttgaaacaacgcttatcgtgatcagtgttttagcgctttatttcgcctatattatctttttcttaatctgaatggcgcaaactgcagagcctatgcttcttctttgcttggaggggttgaaagtgttaggatatgaatatctttaaaatacctgctcattgtgaggaggacattgtgaaaagtgtcaaagattttttaaacaaacacaatcttacgttaaaaggggcgacaatcattgtaggcgtttccggcggtccggactcaatggctcttcttcacgtgttgcatacgttatgcggccgttcagcgaatgttattgcagctcacgttgaccatcggttcagaggtgcggaatccgaggaggacatgcgttttgtccaagcttattgtaaagctgaacagctcgtgtgcgaaacggctcaaatcaatgtaaccgcatatgcacaggaaaaaggactcaataagcaggctgcagcacgcgattgccgctaccagttttttgaggaaatcatgtcgaagcaccaagcggactatctggctcttgcgcatcatggtgatgaccaggttgaaacaatgcttatgaaactggctaagggtacgctcggaacgggacttgcgggaatgcagccggttagacgttttgggacggggcggatcatcaggccgttcttacccattacaaaggaagagatccttcactattgccgtgaaaacggcttgagctaccggacggatgaaagcaacgccaaagatgactacacaagaaacagattcagaaaaacagtgctcccgtttttgaagcaggaatctccggatgtgcataaaaggtttcagaaagtgagtgaagcactgacggaagatgagcaattcttacagtcattaacgaaagatgaaatgaataaagtaatcacaagccagtctaatacatcagttgaaatcaattcctctcaattgcttgccctcccgatgcctttacaaagaagaggagttcaactaatattaaactatctttatgaaaacgttccatcatccttttcagcccatcacattcagcagtttctcgattgggcggaaaatggcagtccttcaggagtactggactttccgaaaggactgaaggtggtcaaatcatatcagacatgtttgtttacatttgaacaatggcagtgcaaaaatgttccctttgaataccaaattagcggagctgctgatgaaacggcagtactccctaatggatatctgatagaggcaaagcattatgcggactcgcctgaagaacatgggaatgctgtttttatcacaagtgaaaaaaaggtgcggtttcccttaacaatccggacgagaaaagctggagaccggatcaaactaaaagggatgaacggctcaaaaaaggtaaaggatatatttattgataagaaactgcctctccaagaaagagacaactggccgattgtgacggacgcaagcggtgaaattatctggatacctggcttgaaaaaatcaatttttgaagatcttgtgattccaaacagcgaccgcattgtattacaatatagacagcatgaaaagtgtagggggcaagcaaaatcatgatgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtaaaaatcattaaagatttggatacatctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgtcggttttgaagttcctgacgcgtttgtagtgggttacggacttgattatgctgagcgctatcgcaatctgccttatatcggagtgttaaaaccggcagtttatgaaagctgatcggcagcctgcttccgagatggttattgtttgtattggaatgattttctatggtactattgaacatagttgtgcttactgtgggaggaggtaaggaatgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgcgcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggctgacgaagaaaagcaagaacttgttgaagttgttgagtttctgaaagatccccgcaagtttgccgagctcggcgccagaataccgaaaggcgtgcttttagtcggacctccgggtaccggtaaaacattgcttgccaaggcttgtgcaggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgccaacgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaattacagtggaccgtccagatgtcattggccgtgaagctgtattgaaagtccatgcgagaaacaaaccgctggatgaaacggttaacctaaaatcaattgccatgagaacaccaggcttctcgggcgctgacttagaaaacctcttgaatgaagctgcgcttgtagcggctcgtcaaaacaagaaaaaaatcgatgcgcgtgatattgacgaagcgacggaccgtgtaattgccggacccgctaagaagagccgcgttatctccaagaaagaacgcaatatcgtggcttatcacgaaggcggacacaccgttatcggtctcgttttagatgaggcagatatggttcataaagtaacgattgttcctcggggccaggctggcggttatgctgttatgctgccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttacggaattcggtatgtcagaaaaactgggaccgttgcaatttggacagtctcagggcggtcaggtattcttaggccgtgatttcaacaacgaacagaactacagtgatcaaatcgcttacgaaattgatcaggaaattcagcgcatcatcaaagaatgttatgagcgtgcgaaacaaatcctgactgaaaatcgtgacaagcttgaattgattgcccaaacgcttctgaaagttgaaacgcttgacgctgaacaaatcaaacaccttatcgatcatggaacattacctgagcgtaatttctcagatgatgaaaagaacgatgatgtgaaagtaaacattctgacaaaaacagaagaaaagaaagacgatacgaaagagtaattcgctttctttctaaaaaaactgccggctgacgctggcagtttttttatgtaaatgatgtgctcaggtgcggcttttacaatcatccaattctggtatcgatttgtttacaaatgagccgctgatcgtgtatggtattgtagaatgtttgtaaaaagtaaagtagagaaactattcaaaagtggtgatagaggttgttactggttatcgatgtggggaacaccaatactgtacttggtgtatatcatgatggaaaattagaatatcactggcgtatagaaacaagcaggcataaaacagaagatgagtttgggatgattttgcgctccttatttgatcactccgggcttatgtttgaacagatagatggcattattatttcgtcagtagtgccgccaatcatgtttgcgttagaaagaatgtgcacaaaatactttcatatcgagccgcaaattgttggtccaggtatgaaaaccggtttaaatataaaatatgataatccgaaagaagtgggggcagacagaatcgtaaatgctgtcgctgcgatacacttgtacggcaatccattaattgttgtcgatttcggaaccgccacaacgtactgctatattgatgaaaacaaacaatacatgggcggggcgattgcccctgggattacaatttcgacagaggcgctttactcgcgtgcagcaaagcttccgcgtatcgaaatcacccggcccgacaatattatcggaaaaaacactgttagcgcgatgcaatctgggattttatttggctatgtcggccaagtggaaggaatcgttaagcgaatgaaatggcaggcaaaacaggaaccaaaggtcattgcgacaggaggcctggcgccgcttattgcgaacgaatcagattgtatagacatcgttgatccattcttaaccctaaaagggctggaattgatttatgaaagaaaccgcgtaggaagtgtataggaggtttagtaatggattatttagtaaaagcacttgcgtatgacggaaaagttcgggcttatgcagcgagaacgactgatatggtaaatgaggggcagagacgccatggtacgtggccgacagcgtccgctgcattgggccgcacaatgacagcttcacttatgctcggcgctatgctgaagggcgatgataagctgaccgtgaaaatcgagggcggaggtccgatcggagctattgtagctgatgccaatgccaaaggagaagtcagagcctatgtctctaacccgcaagttcattttgatttaaatgaacaaggcaagcttgatgtcagacgtgcggttggaacaaacggaacgttaagtgtcgtaaaagatttaggtttgcgcgagttcttcacaggacaagtagaaatcgtttcaggagaattaggagatgatttcacttactatcttgtatcatctgagcaggttccttcatcagtgggcgtaggtgtgctcgtgaatcctgacaataccattcttgcggcagggggctttattattcagctgatgccgggaacagatgatgaaacaatcacaaaaattgaacagcgtctatctcaagtagagccgatttctaagctcatccaaaaagggctgacaccagaagaaattttagaagaagtcctaggcgagaaacctgagattttggaaacgatgcctgtcagattccattgcccttgttcaaaagaacggttcgaaacagccattttaggactaggcaaaaaagaaattcaagatatgatagaagaagatggacaagccgaagcagtatgccatttttgtaatgaaaagtacttatttacaaaagaagagctggaagggcttcgtgaccaaactacccgctaagctctttagcgggtttttaatttgagaaaaggggctgaaagcaggtttgaaatcaagaacaatctggaccattattttaggggcgctgttggtttgctgtattgctgttgcatatacgctgacgaaatcccaagccggcgcatcgtcatccggtgagtctattgcgactatcgggggcaagagtgtgacaagagaagaatggctgaaagaaatggaagatcagtatggtaagtcaacgcttgaagatatgatcaatgtccgagttgttgagcagctggctaaaaagaacaaccttaaaatatccaaaagcgaagttgatcgtgagtttttgctgattaaagcggtcaataattccttttacgaagatgaacatacgacggagaaagagtggaaagaccaaattcgttataatatcctccttgaggaattgttaacaagggatatcgatatctcaaacaaagaattggaatcattctataataaaaataaggaactatatcagtttgatgattcgtatcgaattcggcacattgttgtaaaagatgaagaagaagcgagagaagtcctgaaagaactgaaaggcggatcaagctttgaagctgtcgctgccgaaagatccactgacagatatacatcaccatacggcggagatttaggttttgtcacagaggcatcagacaacattccatcagcatacattgaagaggcgaaaacactcaaagaggatgaatggtctcaggaaccaataaaggtcagcaacggatatgccattatccagctgaaagaaaaactaaaggcaagaacgttctcatttgatgaagtaaaggaccagatcagacggcaaatcgcaatggatcagctaggcgataaagcgacagttaagacactttggaaagaagccgatgtatcttggttttatggggaaaaaagtactaagtgattgacaaaaaattttgaaattgatagattatatacataataccaatacaaatagtcggaaattgaggtgtcgagaatggtacgtgtagcaaactccattactgaattaattgggaatacgccaatcgttaaattaaatcgccttgcagatgaaaacagtgcggatgtatatctaaaacttgaatacatgaaccctggaagcagtgtaaaagaccgtatcggtttagccatgattgaagcggctgaaaaagaaggaaaattaaaagccggtgatacgatcattgaaccgacaagcggaaatacaggaatcgggcttgcaatggttgctgctgctaaaggattaaaagccattttggttatgcctgatacaatgagcatggagcgccgcaaccttcttcgcgcatacggtgctgagcttgtgctgactcctggtgcggaaggcatgaaaggtgccattaagaaagctgaagagcttgctgaaaagcacggatactttgtgccgcagcagtttaacaacccttctaacccagaaattcaccgccaaacaactggtaaagaaatcgttgagcaattcggtgatgaccagcttgacgcatttgtagccggaatcggaacgggcggaacgattacgggagcgggtgaagtgctgaaggaagcatacccttccatcaagatttacgctgttgaaccgtcagattccccagtgctttcaggaggaaaaccaggcccccacaaaattcagggaatcggagctggattcgtgccggacatcttaaacactgaagtatatgatgaaatctttcctgtgaagaatgaagaagcattcgaatatgcccgcagagctgcacgtgaagaaggaattctcggaggcatctcatcaggtgcggcaatttatgctgctcttcaagtagcaaaaaaactcggaaaaggcaaaaaagtattggccatcattccaagtaatggcgaacgttatctaagcacgccgctgtatcaattcgattaaaaaaagccaaaactcccggtccgccgggagtttttttatatttcgtgcatcaaatatgccatgtctgcgacgaatgttattcttggaagagaaattcacttttttcactaacaacattgctttacaattaaaaacaagtaaaaaagaaaatagaggaatgatacaaatggcacaacgcagaccggcaggcaaaaaagtaccttttcaaaaagactcattcttacaacaatttgagaaacttgcgcaatcccggaaacatcatgtacttcttgaaagtgcaagaggcggcagatatagtatagccggtcttgatccaattgcgactgtgaaaggaaaagacggaataactacaattaagcatggtgatgagatgctgtttaaagaaggtgatccattacgggccttccacagctggtttaaaacgctggaaacagaaacgaatcatgagttccctgactttcaaggcggggcaatcgggtttctcagctatgattacgcacggtacattgaaaattttaaaatgctctcattagatgatctagaaacaccagatatttattttcttgtttttgatgatatagcagtttatgaccatcaagaagagtctctatggctgattactcatgttaatggttctgatcaggaaacagcggatgtgaagctatctgagttagagcagatgtggctgactgagcttcccgctgtctcttcgcgagagatgaagcctgaaacagatggttccttcgcggcgccatttaccgaggatgggttctcacaagctgtagagaaaatcaaacaatacattgcaagcggagatgtgtttcaagtcaatctatcaataaggcagtcacagtcactgtctgcccacccatatcaaatttacaaaaccttgagagaagtaaatccttctccttatatggcgtatttagaaacacctgatttccaaatcatttgcggatcgcctgaactgcttgtcagcaaaaagggcaagctattagagacgagaccgattgcgggcacccgttccagggggaaaacaaatgaagaagacgaggcgcttgcaaacgaattgatacacaatgaaaaagaacgcgcggaacatgtcatgctggttgatcttgagcgaaatgatctgggaagagtatcacgttacgggtctgtgcgcgtaaatgaattcatggcaattgaaaaatactcgcatgtgatgcacattgtgtctaatgtccaaggtgaactgcaggatgggtatgacgctgtagatattattcatgctgtgtttcccggaggaaccattactggtgcaccgaaagtaagaacgatggaaattatagaagaacttgagccgacacgccgagggctttatactggatctataggatggtttggatataatcacgatctgcagtttaatatcgttattcgaaccatttatgcaaccggagggcaggcatttatgcagtccggcgcaggagttgtgattgattctgttccgaagcacgaatacaaggaatcattcaaaaaagcttttgcgatgcaaagagcattagagctaagcaaagaagagacaaaaattagatgaggtgagcggagaaatgattttaatgattgataactacgattcattcacgtacaacttggtacagtatttgggcgagcttggggaagagctggttgtgagacgcaatgacagcatcacaatcgaagaaattgaagaactgtctccggactttctgatgatatctcccggaccttgcagccctgatgaggcgggaatcagcctcgaagcaattaaacatttcgcagggaaaattcctattttcggtgtatgtctcggacatcagtccatcgcacaagtgttcggtggcgacgttgttagggcagaacggcttatgcacgggaaaacctcggatatcgagcatgacggcaaaaccatttttgaagggttgaaaaacccccttgttgcgacgcgataccactcgctgatcgtaaaacctgagacgctgccaaactgttttacagtaacagcacaaacgaaagaaggagaaatcatggctattcgccacaatgacctcccgatagagggcgtgcaatttcacccagagtctattatgacctcctttgggaaagaaatgctcagaaattttattgagacatatcgcaaggaagttattgcgtgatgatatatgtgaacggccggtatatggaggagaaagatgcagttctttctccttttgaccatgggtttttatatgggatcggtgttttcgaaaccttcaggctctacgaaggctgcccgtttttgcttgattggcatatagaaaggcttgaacgcgcgcttaaggatctgcaaatcgaatatactgtttcaaagcatgagatccttgagatgctggacaagctgcttaagctaaatgatatcaaggatggcaatgcccgcgtcagactgaacatatcagcgggaatcagcgataaaggctttgtcgcccagacgtacgataagccgaccgttttatgttttgtgaatcagctgaaaccagaaagccttcctttgcaaaaagaagggaaggttttatcgatacggagaaacactcctgagggatcgttccggttaaaatctcatcattatctaaataatatgtatgcgaaacgggaaattggaaatgatccgcgtgtcgagggaattttcttaacggaggatggagctgttgcagagggtatcatatctaatgtcttttggagaaaaggtcgttgtatctatacgccatcgcttgataccggtattctggacggcgtcacgagacgttttatcatagaaaatgcaaagaatatcggcctggagctcaaaacgggccgatatgagctagaagctctcttgacagctgacgaagcgtggatgacgaactcggttcttgaaatcatcccgtttactaaaatagaagaagtaaactatggaagccaaagcggagaagcaacctccgctcttcaattgttatacaaaaaagaaataaagaacatgattcatgaaaagggaggaagagcatggcgcagcacacaatagatcaaacacaagtaatccacaccaagcccagcgctttatcatataaagagaagacgctggtgatgggaattttaaacgtaacgccagactctttctcggacggcggaaaatatgacagcttggacaaggcgctgctccacgcggaagagatgatcaatgatggtgcccatatcattgatatcggaggggaatcgacaaggcctggtgctgagtgcgtatctgaggatgaggagatgtccagagtcattccggtgattgagcggattacgaaagagcttggtgttcctatttctgtagacacgtacaaggcttctgtcgcagatgaagcagtgaaagccggtgcatccattatcaatgatatttggggagccaaacatgatccgaagatggcttccgttgcagctgatcataatgttccaattgttctcatgcataaccgccctgaaagaaactacaatgacttattgccggatatgctgtcggacttaatggagagtgtaaaaattgctgttgaggccggagtagacgagaagaacattattcttgatcccggtatcggtttcgcgaaaacctatcacgataacttggcagtgatgaacaaactagagattttcagcggattgggatatccggttcttctggcaacctcccgaaaaagattcatcggacgtgttctggatcttccgcctgaggagcgggctgagggcacaggcgcgactgtgtgtctcggcattcaaaaaggctgtgacattgtcagggtccatgatgtaaagcaaattgccagaatggcgaaaatgatggacgcgatgctgaataagggaggggtgcaccatggataaagtttatgtagaaggtatggagttttacggatatcacggtgtgttcaaagaagaaaacaaacttggccagcggtttaaagtcgatttaaccgctgagctggatttaagcaaagccggacaaacagacgaccttgagcaaacgatcaactatgctgagctctatcacgtatgtaaagatatcgtggaaggggagcctgtaaaattggtagaaacgctggcggaacgtattgctggcactgttctcgaaaaatttcagcctgttcagcaatgtacggtgaaagtgattaagccagacccgccaattcccggacactataaatcagtagcaattgaaattacgagaaaaaagtcatgaacaacatagcttatattgcacttggatctaatattggagatagagaaacgtatttaaggcaagcagtggctttactgcatcagcatgctgcggtgacagtcactaaagtgtcgtctatttacgaaactgacccggtcggatacgaagatcaagctcaatttttgaatatggctgttgaaatcaagacatcactgaacccttttgaactacttgaactgacgcagcagatagaaaatgaattaggcagaacaagggaagtaagatgggggccgcggacggcagaccttgacattttgttatttaatcgtgaaaatattgaaacagagcaactaattgttccgcatccgagaatgtatgagcgtttgtttgtccttgcgccgcttgcggaaatttgccagcaggttgaaaaagaggctacaagcgccgaaacagaccaagaaggtgtaagggtatggaagcagaaatctggggtagacgaattcgtgcattcagaaagctgaaaggttatactcaagaaggttttgcaaaagcattaggtatatcagtttctattctcggcgaaattgaacgcggaaaccgattgccgtcagctgccatcattcaagatgcagctgatgttttaaatataagtgcggacgaattggcgccgccagaaaaatagaacaaatgaaaggaggagaaaaattgttcaaaatcggagatattcaattgaaaaaccgggttgtgctcgcacctatggctggtgtctgcaactctgcgttcagattgactgtaaaggaattcggagccggattggtatgcgctgaaatggtcagtgacaaagcgatcctttacaacaatgcaagaacaatgggtatgctttatattgatgaacgcgagaaaccactgagccttcaaattttcggaggaaaaaaggaaacccttgtggaagcggcgaagtttgtagaccaaaacacaactgctgatatcattgatattaacatgggatgtcccgtgccgaagattacaaaatgcgatgcgggagccaaatggcttctcgaccctgataagatttacgaaatggtttctgcagtagtggatgctgttaataaaccagttacagtgaaaatgagaatgggctgggatgaagaccacattttcgcagtgaaaaatgcacaggctgtagaacgtgcgggcggtaaagcagtggcgcttcacggccgtacgagagtgcagatgtacgaaggaacggcaaactgggatatcatcaaagaagttaaacaatcagtatcgattccggttatcggaaacggcgatgttaagacaccgcaggatgctaagcgtatgctcgatgagacaggagtagacggggtcatgatcggacgcgctgcattgggcaacccgtggatgatttaccgtacggttcagtatcttgaaacaggtgaattaaaagaagagccgcaagtacgcgaaaaaatggccgtatgcaaactgcatcttgaccgcctgattgacttaaaaggtgaaaacgtagcggtaagagaaatgagaaagcacgctgcatggtatctgaaaggcgtgaaaggcaatgcgaacgttcgtaatgaaatcaatcattgcgagacgagagaagagtttgtacagcttttagatgcatttacggttgaagttgaggcaaaagagcttcaaaatgcaaaagtaggataatactcacctctatttgctgctcactgctagttttacgctggcagtttttctgcttttttcatgaaacaatatctgtaatggagtgataacaatgagtcaagaagagcataaccatgaagaattgaatgatcagctgcaagtcagacgcgataaaatgaatcagctgagagataacggcatcgatccattcggcgcacgttttgaaagaactcatcagtctcaagaagttatttcggcatatcaagatctaaccaaagaagagttagaagaaaaagcgattgaagttacaatcgcaggccgcatgatgacaaaacgcggcaaaggaaaagccggctttgcccatcttcaggatttagaaggtcaaatccaaatttacgtaagaaaagacagtgtcggtgacgaccaatatgaaatcttcaagtcttctgacctcggtgatcttatcggtgtaaccggaaaagtcttcaaaacaaatgtaggcgaattgtctgttaaagcaacttcctttgaattgctgacaaaagcgcttcgcccgcttcctgacaaataccatggattaaaagacgttgagcagcgctaccgtcagcgctacctggatcttatcgtaaacccagacagcaaacatacgttcattacacgaagcaagatcattcaagctatgagaagataccttgatgatcatggatacttagaagtagaaacacctacaatgcacagcattcctgggggagcttctgcgcgtccgtttatcactcaccacaacgcgttagacattccactctatatgcgtattgctatcgaactgcacctaaaacgtctaattgtcggcggtttagaaaaagtatatgaaatcggccgtgttttccgtaacgaaggtgtctctacacgccataaccctgaatttacaatgattgagttatatgaagcatatgcggactataaagatatcatgagcttaactgaaaaccttgtcgctcatatcgcccaagaagtgcttggcacaactacgattcaatacggggaagagcaaatcgaccttaaaccggagtggaaaagaatccatatggttgacgcagtcaaagaagcgaccggcgttgatttctgggaagaggttactgttgaacaggcgcgtgaatatgcaaaagaacatggtgtagaaattaaagattctatgacagtaggccatatcatcaacgaattcttcgagcaaaaaattgaagaaacgcttattcagccaacgtttatttacgggcatcctgtagaaatttctcctcttgctaagaaaaaccctgaggacccgcgttttacagaccgttttgagctgtttatcgttggccgtgaacatgccaacgcgtttacagagctgaatgatcctattgatcaaagagaacgctttgaagcgcaattaaaagagcgtgaagccggtaatgatgaagctcatttaatggatgaagactttgttgaagctctggaatacggtatgccgccaacaggaggtttaggcatcggtatcgaccgtctggttatgctgctgacgaatgccccttctattcgcgatgtgctgttattcccgcaaatgagacaacgctaataaagaagagcggtatcctccatagggaaaggatgccgctctttttaaattccttagtatttcttcaaaaaaactattgcactattatttactaggtggtatattattattcgttgccgctaaacaaggcgataacgaaaaaaagaaattcaaaaaaagttattgacttcactgagtcaacgagttataataataaagtcgcttgaacgaagtgaacaaataaaaatgaattaacaggtacgttttgtcttgtttagttttcaaagaactttgtttaccgctcgtttaagcgactttattatcataacatttaccgccgctactgtcaacaactttttagcatttccttttcaaaaaagctgttcgtcatcagcgacgtatattagaataacaccttcagttgtctaagtcaatacataatatcaattaaatgataaattgcttaatgacgactaacgcagctattccgggtattcctaaaattccgctgatagctgttgtaaccagattaatcggcacatgaatgccaagactgccgccaaacatatttacacaaaccagcagcaaagcacctgccacaaatttaacagctgtgatgccaatccactttaaaggcttcgcagctgaacctgataaaaaaagaagaataaccagtcctaaaataatcccaataataaaaataggctccatgaatcttctcatctccttcgcttgttctagtacaagcttatgagaagatccaggagtttagaccacttacttccaccggctgatttttaaatttcgctgcttcgcttcccttaagtaaaaaaaatacttcgcttcagctactttcagttcgtataacacttcagcagacggttctaagcttttttcaaccagctttttttgcctgttccactcttccttttgcttaaaaagctgctcggttagtttttcatcaaactctcttcttaatgttttcttgcgaagaaaacccatggatcgctttttcctccttacaattcacgtcttccttcaagtgctttagaaagagtgacctcatcagcatattccaaatcaccgccgacgggcagtccgtgggcaatacgggagagcttaataccagacggcttgaggagccttgatatatacatcgctgttgcttccccttctatattagggtttgtcgcgaggatcacttctgtcacttgatcatcctgtaatcgttttaacaattctggtattttaatatcctccggtccgatgccgtccattggagaaatagcgccgtgaagaacgtgatactgtccgttgtattccttcattttctccatagcgataacatccttagggtcttgcacaacacagataacagacttatccctgcgcgtatcttcacatatatagcaagggtcctgatctgtaatatgcccgcaaactgaacaatatgtcaggttgcgtttcgcatttactaatgctttcgcaaaatctaatactacatcttctttcatacctagaacaaaaaaagccagacgaaccgctgttttcggtccgatccctggcaatttcataaagctgtcaatcagctttgatattggttcaggatattgcatgttcttttatccccctagaataaacctggcatgttcattccctttgtaaattgacccattgtttcgtttgtgatttcgtcaacttttttcaaagcttcattcgttgcagcaagcactaaatcttgaagcatatcaatatcttcaggatcaacgacttcttctttgatgataacatccaggatttctttttggccgtttgcttttactgttaccataccgccgcctgcagttccttcaacaaccttttctgcaagctcttcttgagccttcgccatgtccttttgcattttttgcatttgtttcatcattttttgcatattacccattccgccacgcatagcattcactctctttcattttgttagtcttttatttcaattagatccgctccaacaagctttttcgcttcggcaataagcgggtcttcttcagccggttcatttgatccttcattttcctgctgatgatcttctaaaaattcttctcttattttaccccattgtgcttctggaacgccaatcaaatccattctttttccgagcatcgattctaaaatctgctcaagattagtccggactccgttgttatcctcagcgaccattttacaatgaatttcatatttgaatttcagaacaaatgccgccgatccggcagccacaggttcactgtcattcagcaaagcggcatgtgatactttgttttgctgtttgagatgagcaagaagcttgccccaactgtttctgagcagatcaagatccggtcttgtggcttccttcaaaatctcatgaattctgcctactggcgctttgtaattggatttcccgccctttggcacacgcggcgcttcttttttcgggctttccgcagctgcttttatgcccgttgttttgagccgctctacttcctgttcgagctgctggatttttttcatcagcatatccacttccgggagatcagcagcagattgatgtgaggtttggcaaatcttcacaacggccacttcgaaaaagatacgcggatgatttgtccatttcatttcctgatggctcttgttcagaatatcaatcatttcatatagggcctgagccggaatttgttcacttagttcccggaacgtttcatcgacttttactttctcaagcactccctctaagccaggggctgttttgtacagcagcatgtccctgaaatagaaaatcatatcttctatcagcttagctggatcttttccttgctgaagcaattcatttaatgtttccagtgcgtcagaaacgtttttatcatgcagggattgtgcaagcttcccgatatataattgagaaacagcacccgtaattaatagcgcatcttcgactttcaggatatcgccgctgaatgatatggcctgatcaagaaggctcagggcatccctcatccctccgtctgcagcactcgcgatgatatccagcgatccttcctccacttgcagctgttcagcatcaacaattttattcatgcggcctacaatcgcttgggaggtaattcgtttaaagtcaaaacgctgacatctagagataatggttaaaggaattttgtgcggttcagttgttgctaatatgaagatacaatgctcaggcggctcttctaatgtttttagtaatgcattaaaagcgccgatagaaagcatatgcacctcatctatgatatataccttatatgtgacggccgatggggcaaacttcactttatcgcgaatgtcacgaatctcatcaacaccgttattagaagcggcgtcaatttctatgacatcggatattgacccgtttgttatccctttacaggccgcacattcgttgcatggctcatcaacaggagcatgttcacagttgacagccttggcaaatattttggctgcactggtttttccggttcctcttggcccggaaaacagataggcgtgagaaaactttttttgcaaaagggcattttgcagcgtttttgtaatgtgttcttgtccgaccacatcttcaaagcgctgaggcctgaatactcgatataaagcttggtaactcacgggtttgccctcctccgttattcatcattcccattatacatgaaccttgtttcgattccaaaagctctttttacataacaaaagactcacctaatgttaggtgagtctgaaaatttgatgattgatttaccgtgcaccttctgtcgattcgctaccctaagcgttacttaagcagttagctcggcccaggcaaccctgcggcacatgagaggtttcacttaatgctgcttccttccggacctgacatggttcatgaattcccattgcgcaggacccaaacgtcaacaccacttacttaaggcaggccttaaagtaaacgaacctcgagaaaggattcggccctgctagagcggattgcaggtacagggcaccgctacctccccgcttagcacggcaaaataaatatcaaattttatgttgcatctattacgatgcacacttaagtatatctgtttcccctaaaaattgcaaccgtactattcagacaagtttttcctggcagctttcttcttttttcttagttctctgaaaaactcactgagcattccgccgcattcttcctcaagcacaccgctcaccactgcagcctgatgattaaagcgttcctcctgaagaaggttcattagcgtgcctgaacagccgcctttcggatcaaatgcgccaaaaaccactttttccactcgagaaagtacgacggcaccagcacacattggacaaggctcaagcgtcacataaagagtcgcaccttccagccgccatgttcccagtgtcttacacgcttcatcaatcacaagcatttctgcatgggcaatagatcgctgctcagtctctcttaaattatgtgcacgcgctataatttcatcattaacgacaagcaccgcacctattggcacttcacctttctcttcagcctttttcgcttctttaattgcttctttcatataaagttcatcttgtgtcataaggataagctctcttttcaaagttttttcatcgcctaaaaaggctacatattaactataactgaaacggaaaggagactgtcgattgtccaaagcagatacagcccttctcattgtagacatgatcaataattttgaattcgatatgggagaaaccctcgctaaaaaaacagaaaaaatcgttcctcatattttatcattaaaggagcacgcgagacaaaatgaatggccgattatttacatcaatgatcattatggactttggcaagctgatattaaaaacattcagcaagaatgcacaaatgaaagaagcaaggatatcatcacaaagatagctccggaagatgctgattattttttaatcaaaccgaaacattccgctttctacgaaactgcacttcacacccttcttactgagttgcaggtgagacatattatcttaacaggtatagccggcaatatatgtgtgctgtttaccgctaatgacgcttatatgagggaatacagcatcacgattcctaaggactgtatcgcgtcaaacagtgacgaagataacgaattcgccttaaccatgatggagaatgttcttttcgcagaaattacgacggaagaacaaattacagaaaaataaacatgataagcgcttttctttcatacattgatagcgatatgaaaggaggcgtttttcattcaaatttatgtggtaaaacaaggcgacactctttctgctatcgcttcacaatacagaacaaccgtaagtgaaatcactgaaaccaatgaaataccgaatcccgacagccttgttgtcggacaaaccattgtcattccaatagctggccagttctatgatgtgaagcgaggcgataccctgacatccatcgcccgacagttcaatacaacagcagccgagctcacaagggttaaccgcatccagttaaataccgtgcttcagattggtttccgtttatacatccctccagctcctaaacgagacatcgaatcaaacgcttatttggagccccgaggaaatcaagtcagcgaaaatctccagcaggcggccagagaagcgtcaccctacttaacgtaccttggcgcattcagcttccaggcacagcgtaacggaaccttagtcgcaccgcctttaacgaatttaaggagcattacagaaagtcaaaatacaacattaatgatgattataacaaacctagaaaaccaagcattcagcgatgaacttggccggatccttttgaacgatgaaactgtaaaaagaaggcttctaaatgaaatagtcgagaacgccagaaggtatggcttccgtgacattcatttcgactttgaatatttgcggcccgaggatagagaagcctataatcaatttctacgcgaagcgagggatcttttccatcgagagggcttagaaatttctacggctcttgctcctaaaacaagtgcaacacagcagggcagatggtatgaagctcatgattacagggcacatggccaaattgtcgactttgttgttctcatgacatatgaatggggctatagcggcgggccgcctcaagcggtttctccaattggacctgtccgtgatgtcatagaatatgctttgactgaaatgcctgcgaacaaaattgtcatgggccagaatttatatggatatgactggacgctgccatatacagcagggggaactccggcaagagcagtaagccctcagcaagccattgtcatagctgatcagaacaatgcttccattcagtatgaccaaaccgctcaagctcctttcttccgctatactgatgcagaaaacagaaggcacgaggtatggttcgaggatgcccgctcgattcaagcaaaattcaatctgattaaagagctgaatttaagaggcatcagctattggaaactgggtctttccttcccacaaaactggctgctcctgtctgatcaatttaatgttgtcaaaaagacgtttcgataatttggaaacgtctttttttcatgggggcacccaagggttgtgatacaatatgaaggtcggtaactgacgcacgtttttcagatataaggaggattccgatgaatacagccccttttattgcaatagaaggtcctatcggggcaggaaaaacaactctcgcaacgatgctctcacaagaattcggattccctatgatcaatgagattgtagaggataacccgtaccttgataagttttatgacaatatagaggaatggagcttccagctcgagatgttttttctttgtcacagatacaaacagcttgaagacaccagtgatcactttttaaaaaagggacagcctgtaatagctgattatcatatttataaaaatgtgatttttgcggaacgcaccttgtctccacatcagctggaaaaatacaaaaagatatatcacctgctaacggatgatctgccaaagccgaatttcatcatttacataaaggccagtctgcctacattgctacaccgcattgaaaaacgcgggcgccccttcgagaaaaaaattgaaactagctatttggagcagctgatttcagattatgaaatcgccatcaagcagctgcaggaagcagaccctgaacttacagtgttaaccgtagatggtgattcaaaggatttcgttttgaataagagcgactttgaacgcattgccgcccatgtaaaggagcttatcgtatgaaggaacatcatatccctaacaattcaattattacagtagcaggaacagtaggtgtcggaaaatcgactttaacaaaaactttagctaaacggcttggatttaaaacatctttggaggaagtcgatcataatccatatttggaaaagttctatcatgattttgaacgttggagctttcaccttcaaatttacttcttagctgaacgcttcaaagaacagaaaacaatttttgaagccggtggaggttttgtacaggatcgttcgatttatgaagatacaggaattttcgcaaaaatgcatgctgataaagggacaatgtcaaaggttgattataagacttacacaagccttttcgaagcaatggtaatgacaccgtatttcccacacccagatgtgttgatctatttagaaggagatctggagaacattttaaaccggattgaacaacgcggccgtgagatggagcttcagacaagcaggtcttattgggaagaaatgcatacacgctacgagaactggataagcggttttaatgcctgccctgttttaaaacttcgcattgaagattatgatcttctgaacgacgaaaactcgattgaaaatattgtagatcaaattgcttcaattattcatgataatcaaaaaaagtgaatctcagtcgagattcactttttctttaaaataaaaaatccgccgcaccgaatgcaacggacaaaacaatctccaatatatgcttgtgtttcattagaattaaaatcaatatggcggaggaagagggattcgaacccccgcgggctttgacacccctgtcggttttcaagaccgatcccttcagccggacttgggtattcctccgtatcgacaagacttactatatcacgtatgttctcgtgtggtcaagcatttttaaaaactttttttgtttttatgaaaatgccatgtttgcataagcaaaaggcgcaccttctcaggcacgcctttacataatttatggtttcattacttctctattccccatataaggacgaagcactttcggaatcacaacgcttccgtcttcctgctgataattttctaagatagcggcaactgttcttccaaccgccagtcctgaaccgttcagtgtgtgtacatgctcaggcttgcctttcgcttcacgtctgaaacgaatattcgcacgtctcgcctggaacgcttcgaagttgctgcaagaagagatttctcgatatgtgtcttggcttggaatccaaacttcgatatcgtattttttcgcagccgtaaagcctaagtcacccgtacacatgctcatgacacggtatggaagctcaagcagctgaagaacccgttctgcttggtttgtaagcttctctaattcttcataagaatcttcaggcttcacaaacttcacaagctcaactttattaaattggtgctgacgaattaatccgcgtgtgtcacgtcctgctgaaccagcttcagaacggaagcaagcactgaatgccgcatagttgatcggcaggctgtcacctgaaaggatttcatcgcgatgcatgtttgtaatcggcacttccgcagttggaattaagaaataatcttcttccctgattttaaatgcatcctcttcaaatttaggaagctgccccgtccccgtcatgcttgcgcggtttaccatatatggcgggatcacttcagtgtagttatactcatccacatgcagatcaagcataaagttataaagcgcacgctccagacgagcacctaaccctttatagaacacgaaacggcttcctgttactttggcagcacgttcaaaatccagaatacccagctcatcagcaatatcccagtgcggcttcggctcataagcaaatgaaggcttttcaccccatttacgcacttctacgttgtcgtcttctgtttcacccacaggtacagactcatgcggaatatttgggattgagagaaggattgtatcaagctcagcttccactgttcgtaattcctcatcaagctttttaatttcctcgccaacttcacgcatttctttaataatgtgatcggcgtcttttttctcacgcttcagcacagcaacctgctgagaaacttcatttcgttttccttttaactcttcaaccttgccgataagctctcttcgtctatcatccagcgcctcaaacttatcaaaatcagttaagtcttcgcctttgtgtacaagctttgctttaatttcttgaaaatttgctctcagcattttcgtatcaagcatgcgaaacactccttttttattgatttgtcgaaaataaaaagagccctcatccccataaagggacgagagctctcgcgttgccaccctgattgaaaacaaatcaaagacttgttttccactttcaaacataacggttatcccgtaaatgcctacttgtttcagcatttcgctcaaggatggattcagacagcatctttcaccgattcgcaccaaccatcggctctcttagaaagagaggctccctactagttcctatcaacgcttttcgatctttatttgtgcttataatgtactataagtttccacagctttcaactgttttatacaagtgccttctgcttgtattcctcaaccatttcaacaaacagctgtgtcactcggtgatcttctgtcagctccggatggaatgagcagccaaggaattgcccctgtttcgcggctacaatacgaccattatgctccgataaaacttcaacattttcaccagcttctaaaatatgcggagcacggatgaatacccctgtaaaaggctcgtccaagcctttaattgttaaatcagcttcaaagctgtcaacctgccggccaaatgaattacgttctacaaccacatttagaagacctaaatgaggattatctgaaccagcaatttcttttgctaatataattaatccggcacatgttccaaacatcggcttgccctgagcagcgaattcacgaagcggctccatgaattgatacgtatcgatcaaacggcgcatcgtcgtgctctcaccgcccggcaaaatcaacccgtcaacttcgttcagctgctccggacgttttacgacaagaccagccgcgccgcatgcttcaatcgcatggatgtgctctctaactgctccttgaagtcctagtacacctattgttaacatgtcagcagcgctcctatgttcttaccagccgcgttcttgcatacgctgttctggaagtaagtttgagatttcaatccctttcattgcagtaccaagctcttttgacaactcagcgatcaatttgtaatcagtaaagtgagttgttgcttccacaattgctttcgcaaatttagcagggttgtctgatttgaaaataccagaaccaacaaatactccgtcagcaccgagctgcatcatgagagcagcatcagctggagttgctacgccgccagcggcaaagttaacgacaggaagcttgccgtcttttttaatttgaagaagaagctcgtaaggagcacctaggtttttcgcttctgtcattagttcatcctcactcatcgcaactactttgcgcacttgagcgttaactttacgcatatggcgaacagcctcaacaatattacctgttccaggctcaccttttgtgcgaagcatagaagcaccttccgcaatacggcgtgttgcttcaccaagatcacggcagccacatacaaaaggaactgtgtattcatttttatttaaatgaaattcttcgtcagccggcgtcagaacttcactttcatcaatatagtcaacacccatagcttcaagcacacgcgcttcaacaatatgtccgatacgcgcttttgccattaccgggatagatactgcattcattacttcttccacgattgtagggtcagccatacgggcaactcctccagccgcgcgaatatctgctggcacacgttctagcgccattacagcgacagctccagcttcttcagcgattttcgcttgttccgcattgatgacgtccatgatgacgccgcctttttgcatttctgccattccgcgttttacacgttcagtacctgtttgagccatttcttggtccccctaatcaaggtatagttatatgatttctaatccttattgtatcctagaaatccaataattcatatggatatatactattttattcggtttttagcgctttgaaaatcattttttattaaaaattgggttttttcagtatattacgcgaaagagccctaacatccatcagagctctttcaattgattagaaccagccggttaccgtatcaacaatgcttccccaaattccggcaaaaaatccgccgatactgcgcattgtcaaaacaaaccagtttgctttttctacattttcttttgtaacaaggtctacgccagccagatcgctgttaaggaatccgtaatccttttcatcacccgtgtattccgcagtcagcttcccaactttggttccttttttcacaggagcagttaagttgtctttattcagtgtgaccttcgctttgtaattcttttcttcaccatttttgacaggaagagagaacgccttgtttgtcacaatgcctacttctttctctttacccttatcaactgaaattgttttatggccttttacttgatcgccttcagcataaatttctttcatggagaaattgtcgaaagcataatcaaacattttcttcgtttcatcgaaacggcctgtatgaaggttgccctttgcgtttaaaacaacagtgatgacacgcataccgttgcgttcagctgttcctgtaaagcatgaacccgcagagtcagtagaacctgttttcagtccgtctacagtcgcttttttatactcgctgacaagccccttcagcataaaattccagttcggcatgtccatttcatcatcggtgccttctcggaatttcgttttggcgatactggaagtctccagtatctcagggtaatcagtaatcaagtgatccgcaagaatcgccatatcctttgcagaaacttcactttcttcatttacgcttgtcccctcaggctgatgcccgtgaagatctttgttttcaagacctgttgcgttaacaaatttgtaatctgttaagcctagttcttttgcttttgcattcattttttcaacaaacttagtttcagaaccggcaacgatttctgcaatcgcaatagcagcagcatttgcagaataaattgctgtagcttgatataattcttttactgtgtatttcccgtctttccgaagaggaacgtttgataagctgttatcttgggaaatttcatacacatagtcatcaggcgtataggtttggtcccatttcactttaccttgatcaattgcttccaataacagatactctgtcatcatttttgtcatactcgcaattggcagtctcttatctgcatttttactgtaaagaattttacctgaagaagcttcgatcataatagcagcagatgcattgatatcaattggatcgctggctgcttttgcttttgacattggagccagacacgtgacagctagagttaacacaaccaatgacatcagtagctgtttacatttcttgatgttcaatcgtacgacctccgtatttcattttcttcatctataattaagccgttaaggacattttcaaagcacaacagtataaattttatcataatcagtataaaaaaaatagacagagtcagagaccctgtcaaatgtttttaatttgtaacaatttattatgaaattgtatagttaggtgattcttttgtaatctgtacgtcatgcggatggctttcgcgaagtcctgcgcctgtcatgcgaatgaactgagcttcttctcttagcgcacgcagatctttggacccgcaataccccataccagaacgaaggcctccgactagctgataaacggtttcttcaactggtcctttgtaaggtgtgcgtccttcaattccttcaggaacaaattttttgttttcttcttggaagtaacggtctttacttcctttttccattgcagcaactgatcccatgccgcggtataccttaaatcttctgccttggtaaatttcagtttcaccagggctttctgatgtgcctgcaagcaagcttccgagcataacagcatgtccgccggctgccaatgctttagtgatatcgccagagaatttaatcccaccgtcggctatgattgttttgccgtgttttcttgcttcagtcgcacaatcataaattgctgtaatttgcggaacaccgactccggctacaacacgtgtagtacaaattgaaccaggtcctattccaactttgacaacgtctgctccagcttcgataagcgctcttgtcgcttcagctgttgccacgtttccagcaataatgtttaattcgggatacgtttcacggatttttgtgactgtgtttaaaacgccttgagagtgtccgtgagctgtatcgataacaatcacatcaacattggcttcaacaagctttttgacgcgagtcattgtatcgccagttacaccaactgccgcgccaacgatcaggcggccgtgaatgtctttagatgagttcgggaactcaatgactttttcaatgtctttaattgtgataagaccttttaatttattctggtcatctacgagaggaagcttttcaattttatgtttctgcaaaatcttttcagcttcatccagagtagttcctacagatgcagtaactagctcttctttcgtcatgacgtcgctgattttcattgagtagtcagaaataaaacgaaggtcacggtttgtaataattccaacaagcttctggtcttcttcgttatttacaatcggaacaccggaaattctgtatttccccatcaaatgctccgcatcaaatacttggtgatcaggagttaaaaagaagggatttgtgataacgccgcgctcagaacgctttactttatcaacttgttcagcctgctgttcaatggacatatttttgtgaatgatgcccaagccgccctgtcttgccattgcaattgccattgctgattctgttacagtgtccatacctgcgctgatgacaggaatatttagctttaacgtttttgtaagttctacagataaatccacatcacgcggaagtacctcagactttgctggtacaagcagcacatcgtcgaacgttaagccttcttttgaaaatttactttcccacattagtaaatccccctcttttcggcaaaatattatatgtagattatcaactagccaagagcatgtcaaggaagcgggaaagagttgaaatatttagataacagaaaggattaagaaatatacatgacttatcatgagtggaaagacttagcgctattttactccgttgaatcaacccagaaatttctagaaaagatttataccttaaacggtattgacgatgcgaaaaaaaactcttttaaaaacagtgaacggtttatttatttcttaaagcatgccgaatcgttttataaacaagccgcatattctcccttagaaatcaaaccgattcttttattttatggaatggcacagcttatcaaagcatgcttaattacacgtgatcctcattatccaagccatacaccagtactggcacatggcgtaacaacaagaaaacgaaagaaacaaaattattgttttagcgatgatgaagtgaaaatacaacgaaatggcctatgcatacattttatgaaacatttattcggacaatcggatatagtagatgaacggtataccatgaaaaaattattaatggccattccagaacttagcgatattttctactttcatcagaaagaacgatttatgacaaaagttgagaaggataagaacgaaatttttgtaccggaggaagtagtaatcaattacaaaatgtctgattcaaggtttgctgaatacatgtcccatcattatcaatggtcttttacaaaaaaaaatgaacacgggctgctgttcgaaatttcaccacaagacaaggagccatggacatcgaccagcttattgtttgacatggaaaagaaccaatattatatcccttctcaaagggagcaatttctgaggcttcccgaaatgacaattcattatttgattttgtacaacgttgggatgattgcaaggtatgaaacagaatggtggtatgagttattaacacagcatataagtgatgactacgtgttaattcagcagtttttattagtaacagaaaagaaattccctaaatacgcttcacagtttcttcttcatttttaacaaacaaaaaacccagctcaatgagctgggtttaaacttgcttggcggcgtcctactctcacagggggaaacccccgactaccatcggcgctgaagagcttccaccaaaacagctgccagacagacgcatcaaaggaaaaagaggttttcaccatgacaatgtcatcttccgaaagcggaaactggtgctgcatgccggtcagaaaggaaacagcctgacggtgctcaacggccactcctttcggctgcccggtagagcccgatgtatagatgacataggcgagagaaccgccgtcagcaggagtaaacagatggttttctgctttttcgctcgcaagagatgtcatgtccacttcaagcatttcgccagaaaagttcggtgcggagcatcccggctgtgtcagcaagagcgttgccccgctgtctttcagcatgtagctcagccgctcctttggatacgcaggatcaagcggcaaatatgcccctccggccttcaagacagcaaggacagcgatcagcatgtcaggtgaccgctcagacaggacaccgacgatactttcgtttgtgacgccgcgtgccgcaaggtgcgcagccagccgactggcatacaagtcaagctcagcgtacgtcagcaaaccgccggaaaagcgaatcgctggccgctccggtgtgactgccgcctgtcgctcaaacagcccatgcagggttggggcttcaggtgaaacagatactgtcctgttattttgagaaacgattttccgtgttttgtcctcatctagcaatgtcatctttgacacaggaagagatggatcagagatgacgtcagagatcatgtgctgtaaataatcttttatttcggacatcatatttggttgataagtgcctgtatgaaaatgaatccgaacgtacaaagtacgccctggaatcactttgacactgcatctataattagttacctcttccatctcaaaatctttcacggagaaatcaaatgatccagcttgattcagctcttcaatctcttgttgagtaggtgtattttcaaagacgataatatgatcaatcagctcttgtttaagagcgctctgcgcctgaatgtcatataaagggaagtaactatacgcttctgcttcagtcatgtccttttgcatacttctgactaggtcagaaaaagacagaaaatcactttggactcgaataggaatggtattgataaatagtccgaccatgttttctacatcttttagctcagaaggtctgcctgatataactgatccgaacacagcatcgtcgaggctattgaacttttggagcatgattccccataaagcttggaaaacagtgttaagcgtcgcaccacaagctgcagcgattttctgtaattcggaggtttctttctcaggaatggtaaacgtgatctgctgtaatgtcccgtccgacatttgatctgttctttttggcagaggcgaagctttttcgaaatgctgaagcctttttttccaatactcagctgcttcttcacgctcttgctgcatcagccatttaatatacgtcccgtacggctgtacgggaggcaaatcaggaaattgcccttttccaagcgcttgataaatatggagaaagtctttaatgacgatgcctaaacaccagccatccattaaaatatgatggtggctccagatacagacataatgatcaggcgcccattttaaaatagatattctcatcagtacatccgtttggagatcaaagccttttgatttgtcctgttctttgaatgcctctgtacaatgttctttatctttttcattgagatgagaaatatcttcaacatgaacatggcaatgacgttgcttgagcacgacttgacgaggtttggctacatttttatagatgaatgctgttcgaaagatatcgtacctgtcaaaaacagcatccatacttttctggaaacgctccaagtcaagctgtccattgatcgtaaaagaagcctgttcaaaataagctctcgactgctcatcatacaatgagtgaaaaagcatcccttcctgcataaatgacaaagggtatatatcctgtatttcgggttgctgcggcatcagtgaatctcctctccctatagtttgttgacggctcccataatctcactcaattcatcaagcgttaagtcttcatcagtgaaatcagatgcgctccattctcggttttctttgccggtacaatgctcaatgatgttatccagagcttgtttaaaatgtctggaaaatgtttgaatggtttcttcctcaaattgatgcctgttatagatgatgtgcatgttcaggcaccccgaagaaacggcgccgctgatatccagtatataaggacgctcccagtgcgggctgatctcatttcctgtcttgatgtcagaaacctcaaaggcttttgattgaatatcctgatcaaactggcctaaataattaaagctgatttctgggctgtttttctcagagccccatcttttgctgatatacttcagcacgccgtagcccgcgcctttatgcggtatacgatgcagcatatcttttgtctgtttaataaggtggcccagccgctcttctttgtccttaagttcggaatctctcatatcaagccacacaggataaatggaggtgaaccagccaacagttctgctaatatcaatgtcctcaagatatgattcccttccatggccctccatgctgattttaaattggttatttcccgtccatttctgcaaagcaagacctaaagctgtcagaaggatatcattcatctccgtgctgtaagctttatgtgcagccgttaatagtaattctgtgtgatggcgagatagctcaaaatgaatcacttctgtatctttgaatgtgttagatgctgcgtcattgtcttttggaataggctggatgtgacggttctcgtactcatcccagtacgctgcttcgcgctgcacctggcggcttttagagtagtcagctattctttgtgaatacgttaaatatgaatctgttttttgcggcagtttaatagattctcctgagactgcctgtttgtaagccgctgaaaaatcctcaaacaaaatgcgccaagaaaccgcatcaacgactaagtgatgaatcgtcagaaataaatggtcaccattctcggttctaaacaatccagcgtgaagtaaggggccggtttccaaacgaatatgttcttgcatccggctggctgcttcctcaatcgtgttccgggcttctgttaggctatcctttacatcaaacagttcaagtacatatagctcctcatctgaaagatctatccctctgtttatctgcacttgcctgccatcttcatgccggcatacgattctcagtgcatcatgatgagtcacaaggctttttagtacttttctaagcgcagcctcatcaaatcgttcagtccggtagatcataacggattggttaaaatgatggctttccagagattgcgagaaaaaccactgctggataggtgtccaagtaatctcgccttcgaccgggccttggtcaatggcgcgtacgtcttttcgaacccgggcggacagttcaccaagagtctgatgttcaaacatctcacgtactgtcgtttcaaatccgcgctgcttcagtctggcacaaacctgcagcgctttaatagagtctccgccaagctcaaagaaattggcgcttacacccagctcatctacattaagaagatcctcccaaatttcagccatcaccgtttcaatctcatttctaggactgatatcatcagctgtataagcgtgtttttcaggctctggcagggctttctgatcgagctttccattaacagtcaccgggatgctgtcaatttgtatcatacgggcaggcagcataaagtcaggcaaggcgttttttagggaagcccggatgtctgatatattcgcagcctgttgatcttttatcaccatatatgcatatatagctgtttgccctcgctcgtctgctctggtaatgacagccgcctctttaatcattggatactgaagaagtgccgcttggatttcgcctaactcaatacggtgccctctgactttcacctgctcatcaatgcggcctaagtattccagctcgccatttgacaggcgcttagcaagatctcctgttcggtataatctgtctcccggaagataaggattggatacaaaacggtcagcggtcagctcatctctgttgagatatccccgtgccacaccttcgccgcctatatacagctcccctggaactccgatcggctgcaggttcatatgggcatccatcacatgagcatgcagagtagaaagcggccgtccgatattgcttttattttttgcaatgtctgctgcggacaattttttgaatgttacatggaccgttgtttctgtaataccgtacatattaatcaaatcagtatgaggatatttttcattccagctttgaagcaatccgggctgtaaggcttcgccgccaaaaatcacatagcggatgtttaaatgatctgtatgattttggtcttcaagcatcaagccgtaaaaagcagtcggggtctgattgagtacagtgacgcgctctttttttaacaataaacggaatgcatgggggtcacgggctgtttctttagagaccacgactaatgtgcctccgttcaataacgcaccgaacatctcccatacagagaaatcaaagcaataagaatgaaataacgtccagatgtcttcatggttaaattcaaaaggcaggttttgatgcttcaagagactgatcacattgcagtgctcgacaatgactccctttggctggccagtcgttccagatgtgtatatcacgtatgcgggctgatctgttactatttcttgaatgtttacatcagccggaattgagtcgttttcacattcatcgatatacaaaatatgcccattgtagtcagcaggtttgttttgaccacgctctgtcagcagccgttttgccccgctgtcattgagcataaagctaatacgctcctgaggatattcaggatcaatcggcaagtacgcccctccagcttttaaaatcgataaaacgccaatgaccatatcgggtgaccgatcgagcatcagcccgacgatatcgccagttctcaccccttgtttgatcagcatagcagctgcccgctcggctttttcattcaggtctcgatacgtaagctgagaatggccgcacaccactgcgatatgctccggatatttagcggcttgcttttcaaataagcttactatgttttcatttctcggataagccgcatactgtcccattttttcaaggagcaacctacgctctgcagcaggaagcaattgcatgtccgaaattctcatctcggtatccgccgttacccctttcaccaattcaataaaataggatgcccactgcgtaatggtttcttcttcaaaaagagcagtgctgtattcaaaacggcagcgtattccactcggatgctcctcagcgtgtaatgttaaatcgaatttagatatatcatgtttaggagtgacagacgaaatcgacagaccaggtacttcgaaccggaaatcttcactgctttgaagcacaagcatcgcatcgaacagcgggttgcgatttacctctcgatttgtatcgagcttatctgccagctcctcaaaaggataatcctgatgctcgtaagcggtcagagccaggtggcgaatgtcctgcaaataggagctgaacgttttgtggccctcgggcttgctgcgcatcgccaatgtattgacgaacatcccgatgacgcgatccagatcagcgtgcggtcttccggcagcaggcgaaccgacaacaatatcctcttgcccgcttagcttagataacaaaatagaatagacagccagaagaatcatatacaatgttgttcccgtttcagccattaaacggtgcagttcatcagccatgtctttatcaatgttgacttcaattgttccaccgctgaaatcagggagacgcggccttgttttatcaatcggtaattctagtgtaggaagactcccgccaagctgaccgagccagtaggcctcctgttttttgtatagctctttcgggtgcttctcttgctgccaaacagcaaaatccttataatgcaggtttaaagctggcaactcttttccgcaatataagtcagtaaattcttggacaagagtgctcatcgagacaccgtcggcaataatatggtgcatatcgagcagcaaaaagccgcgattattgcccattgtaatgacacatgctctaaaaagcggaccggatgatagatcaaacggtttgataaaggtctcgattgcagactcaagcatttgttctgattccatttcaagctcttttagatcaaaagctatctctgggtaaatgatctgcacaggctcgtctctgtcaagcacaaaaacagtccgtaatgcttcatgccgattcacaagttctgtgagaacgcttctcaaccgctggcgattcagacttccgcgtaattcaagtacagctggcatgttataacctgtgctgtcatctgccagctgatgaagagcatataatcgtttttgcgagaaagacagcggatagacatctctttgatccgcaggttcaatctgtgtaaaagcgtgttcttttaagctcatcaatttgaccgccatgctttcaaccgtcggataagaaaacacctcactgagcggcagctcgacattaagctttttatgtattcttgataccagtgcggccgcttttaaggactgtccgcctaactgaaagaaatcatcacgaatgccgatgtgctgtttattcagcacatcttcccaaatatgtgcgagatcagcttcgattaaggttcggggcgccatatatgtgacactcgtattgttttctggttcaggaagcgcaaacctgtcaagcttgccgctggatgttaatggcatccagctgatgttaataatacttgctgggatcatataggacggcaatgtcccggcaagatgctgatacaagtctgggaggctgtttcccttttctggaacgatataagcaacaagctccttttcctcagcagaaacatcacgggccagtaccgcggcttcctttacccccggtgcttgtcgaagaactgtttcaatctctctcagttcaatacggtaacccctaatttttacttgatcatcaaaacgtccaatatattcaatcgttccatcaggcaaaaagcggcctgcatcacctgttcggtataaacgctccccttcaaggaatggatgatcagagaatgctttctgtgtcagctcttgctgtttgtagtatcctctcgcaagacccgcgccggaaatacacagttcacccgccacgccgatcggctgcatttgatttccgtgcaaaacaaatacttttgtgtttctgatcgggtgtccgatcgtaatcctctctttttcattcagatgccgcaatattgttgttgccacactgttttctgtgggcccgtattcatttgccagttctgcagaaggacaaatcatttgactcaactcaagcagatcaggcgtgaccgcttcacccgcaaatgtcacaatacgaagactttttgcatcgtcagcagtcatcacttccaataacaccctgtacagggaaggaacaatgatcatgtggctgaccttataacgagctatttttcgcttaagggccagcacatccttcgcttcgtcatctgttgtcagcagtacgcacgcaccagataaaagcggggtaaataagctcgttacacagccgtcaaacacgtacgaaaacaaatggagggatatatcctgttcggtcatgccatactcttcccgtctccattgcaatgtattggcaataccgtgatgatcaactaaaacccctttagggcgccccgtcgttcccgacgtatagatcaagtaggctagatcacctggcggcatatttggagcttctgtttggtaactttctgtatgttctatcgttatcgtatttccttcataggacggagggatcaaggaaataaggtcttcttctatcagcaattgagccgcttgactgtccttcagcaggaaagaaagacgttctgctggaaaatgtggatcaagcggcatataagcgccgcctgctttccaaatcccaagcagagctgcaggcatttccattgaccggcccatcattacagcaacgatatctccagatccaacgcctttttctatcagagcgtgcgcaatctgattggctcttacttgtaactggcgataggtccagcattcgtttcccattttcaatgcagcagcttcaggtgttttgtgagcttgttcctcgaacaattgaggtattgttttgttcacataaggacgctcagtttcgttaaacgattggataacctgttgctcctccggcggcacgatattgatgtcactgacggcaacatcgggatttgtcaaaatgcaatccagtgcttgctttagatgcccctgaattctcagcatctcctcccgctcgtaaacgtctgcgttgtagctgaatttgatataaaatgattctcccggaacgataacgatattaaagtcgtaattggtttgttccgacattgaaatgtcactcagcttcagagcgccttcgtcattttcactctccacgcttaatgcctgataaagctgtacagggtaattttcaaaaacaaaaatatgatcgatcaacccttgcttcaatggactatggttttgaatctcataaagcggataatagccatgctgttcagatgataaaatatcctcctgtacggctttgatcagcgaagaaaacgttatgccttccgcagatcggattcgcactggaacagtattgataaacaagccgaccattgattcaatcccgtcaatcgctgacgggcgtcccgaaatgacggagccaaaaacggcatcatctgcagcattatatcgatggagcagcacgccccaaatactcataaacagcgtgtttaatgtcactccccagttttgggcagcctctgtcagtttctcaaccatatccggcgctaatgaaaagctgatctgggcggctttataatccccctctgccgtgcggcgccttattcggggaatagaagcagtattgccgtactccttcaaatattcgctccagtaggcagcagtctcttcttgatcttgttctccgagccattcaatataacggctgtacggcaccgtgctgccaagctgtacaggtgagttatttttgagcgaatcatacatgctgaaaaactctttaagaataatgccgagacaccacccatccatgatgatatggtgatgtgtccagacacatgtatattggctgtctcctctatcaaaaagggcaagacgcattaaaggatctttttgcaaatcaaatcctttttcccgatccttagtcataaaagcatcaatcagcgcctgctgttcttgatcagccaggcgagaaatatcttctctatatactgtcaattcccggtttgataagactacctgctgcggacctgtaagatctggtacttctttaatgaaaatcgttctgaaaatatcatatctagaaacaagaaggtttaagctcttttgaaacgagtcgacgcatagattccctgtgatcgtaaacgaggtctgttcgatatatgctttcgagctgaaatccattagtgaatgaaacagcattccttcctgcatgtgcgataacggataaatatcttgaatttgtgccgattgtgccatcaattccacacaccttttcaaaagttaaagatctttcacgagatcttcgatgctagataatgcagacaacgttaattccttattgctgaaatcgctcaatgttttttcgcgtgcttttttctgcgaacaatgctcaatcgtctcgataagatgcctgtgaaaacgatccataaagcactcaattgagtgtttgctgaacacctgggtgtatatcgcttttacttgaagccgtccgtccgtaatgagagcgttgatgtccagctcatactctcgttctctttcacccgctatttcgtaacggggcttgtaatatgataattcaaacgtatcagcttccttctcttcgctaaattggccgagataattaaagctgacctcaggctctttatgccgcagttctcctatgtgtgttaacaatccgtatccagttcctttgttcggtactcttctcagcatatcttttgtcgtcttaattcggtatgcgagctgatcctcgaaaggctcgggaatacccatgtctagcagaataggataaatggaagtaaaccatccaactgtccttgaaatatcaatgtttggcacatgcccttctctgccgtgtccctcagtgctgatcacgatttggtcatgcccagtccattcagaaagcgccattcctaaagccgtaagcaaaagttcgttggcatcagtaccataggcttgctgggtttcaaacagcaatttttcagtccagtccccggatagtacaaacgcagctgcgtcgctgttcatttggagtctgtccggcacattttctatgtccttaggaagaaaagcagtgtgagcgtctaaaatcgtttgccaatacggtttctctgaaagcaattgtttactttcagctatttgggtaagaccatcggcgtaggataaataagaatccgtttttggcggtaattggatttctttcttttctaaagcctgttgatatgctgcagctaaatcctcaagcagaattctccaagaaacgccatctatcacaagatgatgaagtgcaatcagcaaatgatccccttctgccgttttaaacaaacctgcttgcagcaaaggacctttttctacattcattttgctttgaatgacggtttcctcagcgtcaagtttttcatcaagatgagccctttccagcgatgcttttgtccaatctgaaatataaaggccaaacagttcatgatccttgtgattgattccgcgattaaactgaatgacatggccgttttggtcacgttggaaaatcatgcgaatggcatcatgatgctcggttattttacgcagcgctagatgaagcgcgttagcattgaatcctttttcactgaaaagcatgacggactggttgtaatgatagtgaaaagcatgtacctgtccgaaaaatcttcgctgaatcggggtgagttcagcttcaccttccgcaggtccctggtccgcttgagatgccaatggtgtgatatgtccgcatagttcctgaatcgttgaataacggaataagtcgcgtattgtcatgctccagccttcagctgccagacgtgctgccacttgtaatgctttaattgagtctccgccaagctcaaaaaaggaatcgtgaatgccgactcgtgacatgctcagtacatcttcccatatatacgccatcgttttttgtatgtcgttaactggtgcggtatatggacgcgataacacattatttggagccggcaaggcatttctgtccagctttccgtttagggttagcggcatgttttctaaaggaatcagatgtgcaggaatcatatacgctggcagctcctttgttaaagcagcacggagagcattcgtattgacgtctgaaggcacaatatatgctgccaaaccagcctgtccattcttatcatgctgaacggcaacagcagcttctctgacaagccccgtttgaagcagaacactttcaatttcttttgtttcaattctgtatccatttatcttcacttgataatccattcggccaagaagccggatcgttccgtttggaagccagcatgctcgatcaccggttctgtacagcctttctccagagacaaatggattttctgtaaatttcatttgcgttaagtcaggtttatgatgatagcctttcgcaacacctgccccgccgatgcacagctcgccggcaacaccgatcggctgaatttgatcagtctggctgagtacgtacatgtgtacattcggcagcgggctgccgattggtacgttatctcccgtacactctccacccatactggtttcatagaagctcgaatcaatggttgcctctgtgacaccatagctattaatgatgcgcatgctttgaccaaagcgatctgtcaatgttttgaaatcttgagctttcaccatgtcggaaccaagaatcagtatgtctaagtcaggaagcttgaactgattacggtatacatactccatcaccgggataatgagagccggtgtcgactccatcaccgtgattctccgagagttcatgattttatatatttcagcaggttccagccgtgtttcatctgggcaaacgattagagtcccgccgttggtcaatgttctcgccaaatctcctgagaagacatcgaatgaaaagctcgcgatttgaagcagtctgacaggcttccgatccagttcataaatttgacgccaagcaagagcagcatgagtaaagttctgataggtgacaataacacctttaggcgcacccgtcgttcctgacgtataaatgatatataccggctcttcaggagcaggagataagttaaggttgcagttactttcttcaaaagagccctcatcgtcaaggaagatgtgagacatttcagattcaggcgagttcgaaatcaaatgcttcaactctctctgtaaaagaagaatatctgccccgctatcacgaagaatgtattcaatacgagcttttggataatgtgaatcgattgggatatacactccgccagctttcatcactgccagcacgccaacaattgcatcgatggaccgcttggctaaaacagccacagttggcttcggtccttttctgttttgcaatgttcgtgccagacgattggctctttcatttagaagccgatagctaatctctgtttcgttatcaataacagctatatgttctgaattttcttcagctttcgcttcaaatatgcgatgaaaaggaatatctttttgagcaaattcaacttgagttttgttaaattcaaagactattttttgtttttctttatcactaagtatgtttatttgtgcaaggcttgtttcaggggttgaaagtgccgcatgcagaaattcggtaaaatgatcggcccagcgttcaatcgtagctttcaggaatacttctgtactaaattccatttcgcagcaaatagatccatttatttcagtagctattaatgtgatatcaaataaagatatgtgatgtgcgaaattggcaggccggacttttatttctctcagatctatgtcttgtttttccacattttgaaggataaacatcgcatcaaacactgggttccggctcatatcccgtgtcaattcaagcttatcgacaagctcttcgaacgggtaatcctgatgctcaaaggcttccaatgctgtctcacgcacttcctgcaaatactgtacaaacggcttcccgccctccgggcgcgtccgaagcgccagcgtgttcacaaacatgccgagtatcggctcaagatccttgtgcggccggccggcaattggcgagccaacgatgatatcttcctgtccgcttaagcgtgacaagaacgcggtgtaagccgcaaggagcaccatgtacagtgtgcttacgttttctcgtgccagcttgtgaaggcctgatgcaacctcttgatccagcgtaaatgagaccttgtcacccgcgaagcttcgcaccggcgggcgggcataatcagccggaagatccagcacaggcagctcgccctcgagctgcttcagccagtacgcctcctgcgttttgtacgcgtctcctgttttgaatccttcttgccatacggcataatctttatattgaatgtgtcagggatatgataccgataaagattttaacgccagaagaatatcaagaaataacaggttttatttatccagccacggagccggttgtcatagatttaggaagttaaccaacacccagagaggtgtttttattttgcctctaaggaggtgataacaagaaatggaggaaacgactgtgttcattaaccttgaaacgttggatttagcgagagtttacctgtttgggggtgtgaagtaccttgatttactgctagttctcagtattctcgacgtaataacgggcgtgatcaaggcatggaaattcaaaaagctccggagccggagcgcttggttcggttatgtgcgtaagatgctgagttttttggtggtcattgtggcaaatatcatagatacaatcctcaatctgaacggtgtgctgacatttggaaccgttcttttttatatcgccaatgaggggctttccattacggagaaccttgcacagatcggcgttaagattccagcggccattacggaccgacttcatgtaattgaagaagaaaacgaacaaacaaaagaaaaggatgaacaggctgctggataacccagcggctttttctatattaaaaataaaggagagaacacttatgacaatcacggtgaaaaagaatcttgtatcagaagcaaaatacgctttgaaatgcccaaacgctatgacagcggaatatattactatccacaatacagcaaacgacgcgtcagctgctaacgagatcagctatatgatcgggaatacaagctcgacaagctttcactttgcagtcgatgacaaagaggtgcggcagggcatccctacaaatcgtaacgcatggcacacaggagacggcaccaacggcaccgggaaccgtaaatcgattggtgtcgaaatttgttatagcaaatcgggtggcgctaaatactacgctgctgaaaaattggctattaaatttgtggcgcagctgctcaaagagcgcggctggggtattgatcgtgtgcgcaagcatcaagattggaacggcaagtattgcccgcaccgtattttgtcggagggcagatgggatgaggttaaggctgccattgaaaaagaattgaaggcgctgggcgggaaaacatcttctaaaccgtcatcgtctgcgcctaaagcttctgggggcacttacacagtcaaaaaaggcgatactctttccgtaattgcaaaagagcatggggtgagtgtggctaccctgcaaagcttgaacggtatcaaaaacccgaacttgatcaagatcggccaagtattaaagctcccaggatcaagcgcttccagcactaaaccaagtagcaaaaaaacgttatatgcgctgccttctggcatctataaagtcacaagccctatgcgaaaaggggatgatgtaaggcagattcaaaaagctcttgcagctctttgtttctacccggataaaggagcaaaaaacaacggcattgacggcgtgtacggcccgaaaacagcaaacgcggtcaaacggttccagtcagtaagtggcctgactgctgacggcatttatggacctaagactaaagcgaaaattgaagaaaaattgaagtaataaaagagcctctcatatattgaggggctctaaaatgcaatccttctgacttaatcgtcccagtcttcatcttcttcccagttttctttagattcctcaagatcctccattaaaaactctaaaaagttacgggccacagttcgaccgtaaccctcttgattgtcccaaaggataaccggacattctccatcatcatccattctgtttgtatcaaggcaataagaaaattcatctatatattcgataaccacaattccatcaattaaatcatagtacttcctgtattcttcagtcactgtaaccactcttgcagtagctttaccatgacctagtatatttactccataaactccaccagatccatatttctcaagaaaccatttataactgttgggtaacttaacgtttagtttttcctctatagcattaattttattaatgctaattccacccgtaaaatcgtcatcttctgcattctctttaatgaattgctcaacttgtgaatagttcattaaaatcacctcttactcttgattctcgaattgtctagctctccatttccaatatctctttctaaaattattgtactgtttttcaagtattggatcatttctaaagctctgtccatttcccttcaagccatgcagcactttactatatttgttgtgccagctttcaggtatttcaagcattgtaccactctcttcttggataaggtgatgcaaattaactttagttccatcattagcgtaaggagcatctccttttttcattatctgaagattcgttttccctgtatctgggtctactctgttaatatcaatgtctttcattgtgtatactcttcggcttacatctctaggttgtcctttaacttttactttgccgtctatttcaacagcacgatacttttctttatttaaccaagggagatttatttccttacctgtaaatggttttcttgtttcatctaattttttagcaagctggagcagcctgtcttttgcgctcacatcgttgatgacattataaggcatgccacctgctacaacaacatcttctcgcatggcaaacggtttaattactgttagtggatcaggagtttcatccagttttttagacacttttttgactgcagcttttccggctgttttcactcctattttagcaactgaaccagcaccttttaaagcaaagatgtttactgctgcacatgtaatccagtgagctgttgattctgcgtctccattctttacatctctaacataagaggttattattgcatcttttattgagttaaacgtggaatcatagtgataaactgcaactgcagaattaataaacatgtcgacagggtgattgtgtgccatatagtctaatgtttcagctgtcatatcataaagggcggtaacagtacctttggctccagccattagttcccgtgtgttttcaatctgtgtgaaatatctttgttgatctgctgttagattttcatacccaattgttttggccattgaatagaattcatcggcatccgcataatcataattcttcagtctttctttcagtttttcaatctctcgttctttttcttccttcttcttaatcgtcaaataagcttcagtatgtttttcaatatcgccttttttcttatgtatgtcactgtcacggtacgccttggcgttgtagtgaatgggcgtagcgtttttgcctttgcctgtggattcctcaagcttttggaagtccttcttgatgaattgctcgtttggctctgactgggcatattcagaaacaagcgcttcgtctacgctgtctactttattgattgcttttttgcgttggttctccgcatcggcgagttcgtctttaaaggtttctgtcgagaacaaatcaagcggaagaatatcgtcgatatcatgtaagatatctttcatcgctttcttctgttcagacataatggattttgattttgtgtaggcgttagccagctcgtgttctaagaaggattcttctatatatgcatcagataagctggcgtcttctaaagtgcctgaaatgctcgtcaagaaagcaattttcatatcaagtaagtcaatccaattgtcagctacacctgcgtggtcttgataaaatgctttaatgttgtcggcaccttttccagaaaactctctgtcatctaaatcagctacagctttaaaagccttttttaggttgaccatctgacttcttaattccttgtattcctttgcgcgtctatctgcttctgaaagcagtgatttggcttcaaatactttcatgatcatatcccttcttttggaatttaacatcaaaattttaacacgaggaaaagaagaataattgaaaagtcattgtattaaaagaaaatgattcatttgatctgtgtctttgttcctgttgtgtaaaacaaaaaagtcccgactcattagagagggactttatataacccatattttattttctttatcccaagcaatcgttccttgtcggatgaggctttttatggcctcgcgtatctcctgttcgcctttcccggtctttcttttcaattcgtgaagagtcggattctttccgtatagacgcatattaacaaagatttgatataacttgcgctcaaaatcagtcatacgcgatcaactcctgaagttaataatgtaggaatttatttggctttatcataaaaaagcccagttattagtggtcctccattttcagctttttctttctgaactgatccataaaggataatggtttggttctctttaaaattagtaggaaaaagagcaaaaacattataaatgccatagccgtttttctctttagatgaaattaaaaatttccctccagcttcagcgttttgaatcgcagaaaccttacctttaatacgaacgattttgtctggagggttatctacattgagttcaacgaaatcagcatcttctgccttttttctaatctgttgatgcttttcctcggttgaaatctcatcctgtccatcttgctgagaggaacttgaagtaatgaattctttttcagttggcgaaccacctggttgagccatataagtaaatccacagatggagagtaataagcttattgtcaatatccatattcctttttttctggttcttttaaagaataaaaaaaacaaaccaattacaattccaagtgcagaaaatatagagagaaatcccataaataaaatcataatatcctccatttttttaaaggtaacatttacatcttaaaacagatgagtgtaattttctattctatacagcgggcttaggagagaaaacaaatatggaccatctacaaaagcaaaacttgaagcaaagttgaaataaaaaagaagagccctcatcctggggctcttacaaacttaattctttttgatttatataatttagacatacattataacagtcttcaatgtgagattttccaaggcttttcattgcgaaaaaactaattgatccagatgcgacttgacctacaacagggataaactttgctgtgcttttagttgcaattttttttaacccaatctttttgagtaaggttgtaattgtttttttagaaatcattttcccaatcatttcactgccaatggatgttgctaaaacgagtatcatttttttagattcgacatctaattgttcaatctgttcttcacttaaaccaaattttctattaattttcggaattaactccatcataatagctacgtcagttcctacgtcaacacctggtaccggtattgctccagcgaggccagaagcggttgctcgtttgttaaccatttttaggcaatccttttttattttgtccaattctgctttggatgacggtatcaatttacttcctcctaattacttgctcatgtcctgttattgttactatcggttaaatacttcaaattattagcattttttgatcaagagagagtatgttttttttgttacatctattgacggttgtaaatagatattgtataattagagtatagaaaggaggtgctgaagtggacgaggtgagaaactggattcttgctatcgctggtatcgtgaccatcattaaacacatctacgacatatggcaaaaggaaagcgaaaagcatagcaagaaaaagaaaaagcgctcccgccggacaagcaagaagcgctgatactagtgagacaaggggagaaatccccttgctcatacattatatcacgtccacgatagtatgaaaaaatattttaagcagtacagcacaggtgactttgccgttttgctcattttggttgccgggatcgttgcaattgatctgactgatgagggtatgtctggaaagattgcgcatactgtattgatgatagccgttgttattaccttgttaaaaggattcattatgatgtggagagaaagccgacatgaaagaaagcgaaaaaattaagtttatccaagaagaagttttgactgcagcggaagcgggggagctgcttggaattactcggcagcgtttaagtaccctggtgacttccggaaagctcaagccggttaaaaaggttgggacagtcgcattgtttttgcttggacatgtacaagctcttaaaaaagaattagaagccggccggaagaagtaccgtccttatgatgaatgaagcccactcatatgagcagggcttttttacttttctaggaatcgcgtggtacttttctcccctttatctcgaagtgagagttttttaattgttttaagaacgaatgttctggtatcttctttttgaggtgataggtgtgaaagagctaccaaaagagctacttgaagaacttgaaagaactaccttcctattaaacgaagttatagagatatacgagaagcaccaaggggagccagaagaaaaaccggctatcacttgcccatcatgccgtaaagaatcgactaattatgtttgcgattggtacggtaataggcacgtccatttcctttgtgattgcggctgccgtgtccatcaataaacaaaaggcctctcgtcatacgaaaggcctttttacttatgcgcctactcttatttcacgacctaaacccattccaattgctgggtcatggtgtgtacctaccggtaactcacgttgaattttcatcttaatcactccttcctataatgaggaatactgcatctttcccaattctccttttttatttaaatagattccgtaatagtttatttgttgctttaccggctgcacggcgggcaatacgtttcccgagagtgccgtttttagcagcattaacatcccctaaaattttagccgacttgtagagcgctgatcttattttattaatgttcatttttcctcgtcccttttgtgttggtgattttattataacttatactgcttgaatgtgggcacccacataaacacccacaaaagtaaataaagtaaaaaaagattacggtatgcgtttttcaaaaacgttgatataccggtctctaagtgaagataaaaacccttaaataatcccttgatgaaagaacgtaaaaaatacggtcttaaaggcgctcgtcgtgcacctcagttctcaaaacgttaattttacgttttcaaaaagctctcgaccttgggttgggagcttttttcttttaatataacgtggccagctccgcataaaaataacactgaacggacgcttgacggggttaaacaaattgtttgtttataaacggtctcactgtaaaagtcatgatagctttcatttttattcaattggaagttcggtcaatgtttattatcgttatgtgatcagcccagcttcatctaaccactgtatctcatccgttaaagttcactgctgattcttaacccggagaaacaatagctctcattgctaatggctttatgtaacgaagtaaaagtaaatctgatgatataaatcacatatctcctttgtgatttttttgcgtttttatgaacttttttctaaatatgcaaagggaaagcgatatcaatctagaaatatttgttatactctatacattaaagtaaggagaagattcatgaatgcgttagtagctcataatagcaaagcctgggataaaaaagtagaaacaggcaatgaatggactgttgctgttgaacagcaggttatcgaacaagcaaaaaaaggcaattgggatataagggtaacaccaatgaaagatgtaccgaaggattggtttccgcctgtcaaaggtctgaaagtactctgtttagcatcaggcggcggccagcagggtccagttttggcagccgcaggcgcggatgtcaccgtattagataactcagaaaaacagctgagtcaggatagaatggttgctgagcgagatggtctcacgatacacactgtcaaaggaagcatggacgatttaagtgtatttaatgatgaattatttgatgtcattgtacatcctgttgccaatgtttttgttgagaatgtcctcccggtatggaaggaagcgcaccgtgtgttgaaaaggaacggcattctaatctcgggttttgtcaatcctgttgtatttctgtttgatacagaattagaacagcaaggtgttttaaaagtaaaacactccattccatacgctgacccagaagatcttccgaaacatagagtgaaaaaactgatcgaaaataatgaggctctggaattcggccattccttagaagaccaaatcaaaggccaaattgatgccggttttatcgttactggtttttatgaagataaaggcgggtttgtattagaccaatatatccatacatattctgcaacaagaagcgtgaaagtatgaaaagcagcgacctgttagaggggctgcttttttcataaccaattatagaacgtttgttccgcaccctgcggaaggctgattttttatcgattttacaccttcatttgggcgaatttccaaccgaattcgggcattgtttcatcatccaaacctcaaaataatcggtaaaaggagagtgaatttatatggtagaagtactgtcttttatggatgtgaaacgccaaaaggattttgaattagaaaagaacttgctcaaagaactctctctgagacaaattatccagtctgttaaggattgtttggaaccattatttccatttttacatgatgaacgagatattattactgaaggctgtattgattttgcgattgaagcttatttgttaggcgggcgttttgggatattcggctattacggagaatccatgcaaagtatcagtgcccgctctgcaagagaagaagaagagctacgtatggagttttttgattatctctataattggatacacgagcaatacgcaacatttgataaaaacacggtttatgaagcggcacgcaagttcattaaagattggtggacagcggggtttgttcaaagagaaaaacagtgtaagcttcgcatgcgataatcatatttcccggccctgtcccatagttatgtaataacggacaagcgggaggggaagggatgaggaaaaagcttaaatggctcagttttttgctaggcttcatcgtattactatttctgttcaaatatcagttcagcaataacgtctcttggaagccgtggagcctgcccttgagcggtaaaatcatttatctagatccaggtcatggcgggcctgacggcggagcagtcggcggaaagctgttagagaaggatgttaccctgaaagtggcctttagagtcagggattatcttcaagaacaaggagcgcttgttatcatgaccagagaaagtgatactgatctcgctccagaaggaacaaaaggctatagtcgacgaaaagctgaggatctaagacaacgagtcaaattaataaaccattcagaggcggagctctatatcagcattcatcttaatgcgattccgtcacaaaaatggagcggagcccaaagcttttattacgggaaatatgcggaaaatgagaaagtcgcaaaatacatccaggatgagctgagaagaaatctggaaaacacaacccggaaagcaaagcggattcatggtatctacttaatgcaaaacgtcaccaaaccgggggcgcttatagaagtcggatttttatccaatccaaacgaagcaacgctgctcggtaaaccgaaatatcaagacaaggtggcatcttccatatataaaggcattttgcgatatttcacagaaaaaggagaccctccggagtaatggagggttttcttgtggttctaagcataagacacccgccatttatgtatgatataataataattgtaaacgaatacacaaaagggtgaggttcgatgataagagaagatgaagtaagaaaactagtcggagaaatgcgcgaaccttttcttcaaagacctctgggagaattggatgccgttaaggaaattaaaataaagcctgaaaaacggcatatcagtgtaaaagtcgctcttgcaaaaacaggaactgcagaacaaatgcagattcagcaagagatcgtaaacgtattaaaaggggcaggagctgagacagtcggccttcgatttgaagagctgcctgaagaaacggttgctaaattccgggcgccgtcagctgagaaaaaaacattattaaatatggataacccgccagtctttcttgctgtagcaagtggaaaaggcggcgtaggcaagtcaactgtgtcagtaaacctagctatttctctggctcgtctagggaaaaaggttggtttaattgatgcggatatttatgggttcagtgtgccggacatgatgggtatcactgtgcgtccaacaattgaaggagagaaacttcttcctgttgaacgctttggagtaaaggtcatgtcaatgggctttttcgtagaagaaaatgccccggtcgtatggagagggccgatgctcggcaaaatgctgaataactttttccatgaagtagagtggggagaagtagactatattgttcttgatcttccacctggtacaggggacgttgctctcgatgtacatacaatgcttccgagctgcaaagaaattatcgtatctacgccacatccgacagctgcttttgtcgcggccagagcgggctctatggcgattaaaaccgatcatgaggtcgtgggtgttatagagaacatggcttattatgaaagtgcaaagacaggggaaagagaatatgtgtttggaaaaggcggaggagataaactggctgaggaactaaacgtgcctttactcggcagaatcccattgaaacagcccgattgggataaggaccaatttgctccgtctgtttatgacgaaaatcatccaatcggagaaatatatcaggacatcgcaaaaaaaatagatgcaaaaatgtcagtgcaggtataaaaggtgaaccgggattccagatcccggctttccctttattcactttctttggccgtgtcttttgctgcttttttcagttcatcttcgaactgttttttgtaaagcggactagaaagtgtttcgttaataacctcttctaaataactgcggaattcttggctttttgccagctggctgtactttttatccatgccgggatcctgcataacgctcatcagcatcttctggtaatctggatccttcatcagctttttaatcactttttcatgctctgtttgaagagttttggcaaagccctcagcaaaatcagtgtcttcaaagatgtttttccaaaatttttcaccttttttagatgtgagtgttttttctattgttcctttaattgcatcttggtcaatcaccaacgcttcattcatggcatcatcatttaataattccttaatagctttctttccatcatcagtttttaatatatcaacaaccatttttttggtctgatcatagtccatatccgctgcttggtcttttggagcgcaagctgttacagataataataaaaaacagctcatcaatagcgttttggcttttgacatgcttaagctcctttcacatattgtcttacctttaatatgattcatctgtttggaattatacataacaaaatatcgctgttcgcgatttttgaggggatgaataaagaaatgaaaagccgtggtttagttcgttttttcttttctattttagctgtcggggcgcttatcacgagtattgtgggttttgctttaaaatggggagaatatagagggctgtttctgacatttgaagcgggacagattttctctgttttattttggtttatcggtgtaggcatgattttcagtgtgatcagccaaatgggttttttcgtgtttttaacagtccatcggtttgcgcttgagatattaaggtcctcctctttgtggaatttgctgcagttgtttttcatcctgtttgttgcttttgatttaatgtacgtgcgttttttattttttggagagagcggagaatcgctggctgggtatgcgtggttaccggtgtttttattgatctttggagtgattacagcttatataaagcaaaagcagtcctctaagaaaacatttgtgtcatcgttgtttttgatggttgtgattaccgcattagaatggttccctgcattaagagtaaatgatgaggactggctttatttaatgctttttccgttaatggcatgtaatgccttccaattgctgatgttgccgaagtttgcagcaaagtaattactttacctctgcggatctggcatcagaatttgcgatgagatcacccacggttacattttttaatcctttttctttcagctgatggatgatatcaggcaatgcttcttctgtttgttttgccgaatcggaggcatgtaaaagaataatgtctccaccggaaacttgcttggtcacattgtcgatgattttttcaactccgggatttgtccagtcttgcgagttcacactgtaatgaacgactgtataattgtattgctttgcgacctttagaacattcttattgaattggccggtagggggtcttaatagctgtatgtctttgacccctaacttttcaaaggctgtttgcgcacggttcatgtccttttttatttcgctgctctctaaattggcatagtttttataagcgtagcccatgctcccgatttgatgtccgtcctttacgatacgggccactgtgtcgggatggcgttctgcccaagaagcggaaagaaaaaacgttgcatttttaatcccgtttgctttcagagtattaagtatcggttctgctctctcatcaccccagctgatatcgaaagtaagtgaaatatctttagagtctgtttctcctttataaatggctttaggtccggtgtcagttgaaaacacgggaagcgggacagctctttggatataaaaaaagctggcagctgcaaatgcggcgataagtataataattaattgttttacccgtttaatgtgccacacatagaagtgattcactgatgatgcctccttatcttgtccatcattcttgttttacatcttatgagcatggacaattgaatataaccgataaaatgtctcttcacatagcctaaattaggtgttgaccttttgataatatccgtgatatattattattcgtcgctgataaacagctgacatcaactaaaagcttcattaagtactttgaaaaaaattattgacttaaaagaagctaaatgttatagtaataaagctgcttcgttaagcggcggtaatgctatacaggttaatgaattcgaagccaaaaatcaagtttgccaacaaatccgaatttgataaaccgctttattaaagcaaagtaaaaaaaaacttgctacgcaagggtttaagctatgattccgactgggcttagtatcatcaaacgctattatttttcgttgttgtttcttgtagctgaatttcctgttttcgtctgctgaaataaccaaacagttattgagcgaataaattctgccacctttaatgtctttatcgaggtgccatttgtttcctttttcatataataattttccgtttagcaaatggttgtcaacgtcctcaacgaaattccaaaagtcatgccacctatcatcaactgtgacacctttggctccataatatttgtactgcgaatgattaggattgtaacaacggctcataatgccagtccatcacctgtgtaacgggtgttcttttttattcatgtagcttcctcccaatttatatatcgctattgtattgaaaggaactccacctgacaggcaatattcggaaaaaagaaaacaccagctcaacgaactggtgcaatcctgtcacaaatatgtttttaacattttaatttggaaagctctaaggttatcagagtaatatttatagtttgctattgcagataaaaatattgctatttgaatgattactccagcccagtaaaaaaagttcattgctgaaccatgtgtgatggcgattatagctgttcctaacaaagacacaatcaagcttacaaacaaagagccaaggccgtgaaccgtacttagcaaatatctgtatcgttcctcaaggtatttccttgtttcttcattttgattcaagagcattgaatgccacacatattcaagctgataataatcatcgttattattttgcccccattcatcatgtttagggaactggtcaccaatcttagtggctatttcttcaaagttcctgttgttattgaatacccatgcgataccaaaataaagctgatgtaacaaataaccgattggcacaccgattgctgttaatgataataatagcgttaatcctgttttaatatcagccattttagaatccaatgggttaatgccttttaggaacaaaaattcatataacagccagaaaatcagtatccagccaggaatcccccagcgaattaaatattttgtttcaaatttcatttttgaaactcactcctttctttatactgttttttaacaaattcattaaatccttttttaaattaaaaaaacacccttgagggtgccttttatgaaaaaattaatgcagccactaataaattcaagccattgttttcaacattgaacttacgtctgtaatcactgccattgtaagtgttaaaccattcttcaaggtattcttcagtttctggcttctttgcaaaatcagctaagtcaggtatgtcgtacttttcacctaaataagtgaataaagttttgtttaagcttttctcttcaatcaaactgatttcttctttagctccattgtcgattaaatgattaatcaataatgttggaaattgtaagcctctgctactcatattttcacctccaatttacttattcgacaaatggttacattttcctgaaaggtaatagtaactattgcaaaataaattaaaacgcacagctttgaccgctggtgcgtttagtggtgttcctccatatattcaatttgtaactgtttaattgcctttgctcgtttttcagcttgttgttcaattattggtattttagcttccatcactggatctttgggaaacgctactcgtaaaaattgaatcatcattacagttattaataacatcattgctacggtcaaggcaatatacgtggttacggttttaatgttgttcattgtaagaactttcaatgtatgattgaccgttaagctcggcaatatcctgacgtaatttcggtgtgtcaacagacgaagaattaatagaaagactgagaaccgatcctaacccacatattacagtttcatctacttttaaagatagggctactgctgagagaattgctaattcagttttaaacgatccaaaaaatataaagaaaatcgaaaattggattgatgatcctaaaaaacctaaattaatgttaagatacaagggcgatggagaaataatcggtagaagtgtatcaagaaattcagaactagtagaaaacgttacaaacgcaaaaattatactcaaaaaagataacaacggtaactttattcttacaggatatccaaccaaatagaaagagaggaagtatcatggatgaaggttatgatttcttagacgaattagaaaattttttaggtgcaacatttcatcaagatatccgatcccctgaacacgcattagacgaatttattgaggaaattagtaaagaaggtttgctatttacagtaaagtattgcgaagagtttctaaatagcgatctaactaaagaagaaaaggaagacattataaagtgtaatgccgaaatatatttcccgacaattggattaccacctatagactggttgaaaagtgtaatagaacaactaaaagaagctatttaaaagtgacactgaaaggcccccattttaagagggctttttatattacttcaatttcgcttttgtagctggttcataatagccatcgatacctgaagaaaatacaattagttatctagaaaattgtaataaagaagatttatattggatcagtgaggtatttgaagatttagctgatagtttacaaagtaaagaacttattaattgtttaagaaaattagatgaaaaaataccctgacttagaaatgacaaacgatattgatatagcagaaagttatatagaataagattccaccatttctcagatttgaagttaacatttcttggcggtgataagtaatgattgaaatcgaaatttatgaacctgtatttcaatttctaggaggtatatttcatcaagatatagaaactccagagtcagcactggacgaatacttagaagagattccaaaagaagagcaaaaaactgatatagctgcattgaaagatttttttaacagcgattattcggatgaagaaaagaatgattttatcgatgaagctgctgacggagtggacgttcttagttacggcgtatctccaatcatatggctcgaacaagttattcaaaaaatcgaaaagaatattgaaactttaacctagcatagaaacagagctgattttgaattcacttcaaaatcagcttaaaaaaactttcgtccccaattcgtccccaactcgatgaatgatgacaaaatcaataaataggtaaagtaaaaaacccttgctacgcaagggtttaagctatgattccgactgggctcgaaccagcgacctctaccctgtcaaggacgagacacgtattctgactaatctttaacaatcctaaaaaatcgactaaacccttgtcacataaggggtcatgggatttagtttcctgattgatatttgttgttactaagtggtttttaaagtttttgtgactccatggtgacacaaaaagctagcttcacaagtcctcaatttgagggttagttagcgagtaacaaaacaggactccatctattacctcgcctagctcaataaaaaagacccccaaaagggagtcttattcttaataaatctcatctaaaagtttctcacttaaatccttaaatttaccttcatctttcagagcattaaggagcgcaatcactttcttttctttaattccaagaactttagataagatatcacgcacttctgcaaaatcaggagctttctcattatgtaattcctgatttgaaatgccttcaatctcttttcgatattgttctggtggctgaggactatttagaatacgatcatttaaaactgataaaacatattccaattctcttcttttctcactataaatattatgctgaattaaccaattggaataagggtatcttggatcatccagttttgcatgactgagctttaagatttgccatttaagctcttcaatttcttgctcaagtagttcaactttttcttctaattgattagtcatttatagccctcctgtgaattatagaagtatccaaagtaccccttcaacagcttcagctatcactaacgcatctcctgaatctaattctaaatcatttactagatagttatagagtttctttcttacggtatcaacagctaaatcaggtattttcgcaatgtaatcaagctcgtccgcaatatcatcggcatgctttctaaatgcttttgcagcaccttcatctaaccaaccaataatctttgaaactacccatgagccactacgaattccttgagctaaggctcttactgccgcagagacaattttacctttaataccttgagtagtgaattctccactaacctcttgatttttcaccttaacattttcttgtagtggagttgtataagcatatgcattagcaataattacattttgcttcactgactcttcttttttaatttcttttgcgctcgcaaatggtgcaaaaagtgaaactgaaagggctactgaggataaagccaatatactttttttgaacatacttcacaatccttctttctctttatttttttgaaactattatcaatattatcaaaaatttgtaaaattaaggatagtgtttttctcacctttttgttcccctcttttatgcccatgttctttgtcaggtcgttgttatttcaccaacgagcatacagaggtcgtggttgttttgtctacgacctcattgtggtcgtggattgagtcgttgctaatttgtccacgagtgtaggtgagtcgttgccacttttggtaacgagtgtcgtatatgttttgggtacgacctcatggcggtcgtctattttggtgacgacctctccactattacaattggtaatagtctcagtccccaaagttgggttttgacagagagacatcatgaatctctgtctcctttcgccacttctcgggaaacgatggttcatactgaactgtcgtttgttggtttcatttaagtatatatacttaaccaaagggtttgccaggttcatagtgaacctcacaaatttctttattatttgtcttgacttttcttttggtcttttgcttgattggttgagactgtggacaacggctggacaagttgtctgcctgaatttgcttgtgaaaaaataaacaaactcaggcaggcgactgaaacttgattgtatatcaacttgtggtatccgtatgctcaccctatttgccgttggttattccccaaacaagcctactgtgtcaagtgtccctaacagtttctcaaagctcaaatctgagcctgatacttatggcttgtcctacatcgtcagaaacgatacccccttccttcgtcagcatgatccttaaaaaaggcatcactaaagacaacaccttaattcaggagcatagactgactttatttaattgtaaggagtcgcattgcacgccccccttgattaaattgttgagtttaaatacaatggaaaggtatcaacccttttacgattaggagagtgtgcccgcactccctaatcacccaaaccaagctacaaactggatacatatagccggtacagctacaaataatactccaaaagccactttacagaaccaatcgttatgtatctcagttttattcatcagcgtcagcttcctctacgtcatactcaccaatcctacataaattatcgctaactctagggataactatttgtcctccgcccatttcaaacaacacatgtatatgattaattgccatttgcaacattgactctaaattgtctcttgcatcctctttactttcaccatctatattgaaggaaacaggaatagtgatttcagtatgtatgttgaagcgctttgtaggcgctccattattacttgtttcaatgaaattaacttcttctgatttgttattcaggatgaaatggtgaaagtgattagctatatcctcaaagcgttcctcgttagtgattgtccctaagctcgttacgttagttcctacagtgtgtcggttaatttgcattgtcagtatcccctttagtatgttttgtttttgtctaacaactgaaagccttctaatgtaattagctctcgattatcaataagtgcatcccataaggttgtgtgaagcagtttatcaactactgcattagtcagagtgacaagacttttgtattgaatatcttcggccaagaaatctgaatgaagcctatcgtacagcccatcccctctttttaagacttgatatagatgaacttgaccatcttcaccagctattgcgaactgcttataaaagagtattgcgggtaaattacctaagtcttttctgtggatgattatgtgtttcaatattatcacctcttgttaatctctatttgtttaactccttgtgttgataatatatcatcatttgtttaacgacaagcgttaaatcgtcattattttttgcgttggtttgtggtattattatttggaggtgaatacttttgatcaaatttaaattagataaactattagaaaaacacgataaatcaatgtattggctttctagaaaaacagaaataagaccaaatactattagtaaatgggttaataatgagcaactgagcgaagaagaaaaagtaaaatctataaatgttgaagcgttagacagaatttacaaagtgttaaattgcaaactggaagatgttattgaatttgtcgaggatgatcctaaagactcttaagcaaaagtattgcttttattttttaattcgttaaacaaaaccattgaaatattcgattgtcggaatttccgacaatcaaaagtattgcaatagctttacactgtacggagaggtgaacgggatggagaacaatatgcttcaagcaatattggatgaaataaagaaaattgataacaaaattgatggtgtgtcatctgaattaaagtcatttaaaaaagagatgaattgaatttagagaagaaacaaagaaggaattcaatcagattaacgttaaattagacagacttgaggaaaaccaacctcaagatattacagctcatcttaaacagctgtagaatgtagataagaagactggtgtgaaaaggacgattacaatgaaatttctaggtttaggactaattctagcaataattgaaggagttattggatactttttcagaggaagtgtatcttatgaaacagtatttggtacagtatcaatcattttaataggtatatccgttctaatttcaggtttagcagtaagtggagaccgtcagcgagcaaatcatcattctgaaacaaaagaacacagacagtttagaatcaaaaatactttaaacctcatgatcacagcaataccctctattgttgttcttattttcttactcagcacaaaataaaaaatcttaataaacgagtgtttgaacttgatgaaagattgaacaactgagtaaaattgtgagaagtatgttcgaataatctactctgaccgagctcccacatttttcatttggtatgtgctatgctttttacataccaaataaagggggctttcaattgacaacttctcatgaaatttctgtttctgtagggaatgaatttaggcgttccaaacactttaaatcacgtagggaagcgtgtaaattccttgaaagtattagattaaagtttgaagataaagaggtatttccatgggatgaggaattcccacgattcaatgtgtatctaaagtattgtcatagtcacctggggaaagtaagaaaagggataatggcaccacttggtacgcctcatagccatttccctgcagaattagaaagtgaaatattgacgtttatggaagaagaatacctaaaacgataaatgaaaaaccccttcacatttttgtgagggggttatttcgttcttattaatcttcccagtcttcatcttcttcccagttctcttttgcttcttcaagctcttccataaaaaactgcaaaaaattatctgcaactgtgtctccataaccagcttcgtttgcccaaacaattactggacattcgccgttttccatcttatttgtatcaagacaataagaaaattcatctacatactctattacgataataccgtcacttaaatcataatgagttctatattcctcagtaactgtaacaactcttgcagaaactttgccatgaccaagtatatttaccccgtaaattccacctgaaccatacttatttaaaaaccacttataactctcgggaagttttacatttaaactgttttgtatctcttttattttatcttcacttattccgcctgtgaaatcatcatcttcagcgttttctttaataaattcttcaatttcatgataagtcattgttacatctctcctttctcaaattggctcgctctccatttccaatatcttcgttggaagcttttatactgatttcgcagctctttgtcatttctaaaactctctccaccttttttcaatccatgaagaacttttttattattttgatgcactgaagccggaatttccaccatcgttcctggctcttcttgaattaagtgatgcaagttgatctttgtgccgtcattagcaaaaggagcgtcaccttttttcatgagttgtaaatttgtttttccactttcagtatcaactttgtttatatcaatatctttcaatgtgtatactctacgactcacatctttggttttacctgaagcttttaccttccctttaacctcaaaggcaccatacttttctttatttaaccaagggagatttatttccttacctgtaaatggctttcttgtttcatctaatttcttagcaagctgaagcaacctgtcttttgcgctcacatcattgatgacattataaggcatgccgcctgctacaacaacatcatctcgcatgacaaacggtttaattgctgttagtggatcaggagtttcatccagtttttttgacacttttttgactgtcgcttttccggcagtttttactcctattttagcaactgaaccagcaccttttaaagcaaagatgtttactgctgcacatgtaatccaatgagctgttgattctgcgtccccgttctttacgtctctaatataggaggttattattgcatctttaattgaattaaatgtggaatcatagtgataaactgcgactgcagaattaataagcatgtcgacaggatgattgtgtgccatatagtctaatgtttcagctgtcatatcataaagagctgtaacagtacctttggctccagccattagctcacgtgtgttttcaatctgtgtgaaatatctttgttgatctgctgttagattgtcataaccaatggttttggccattgaatagaattcatctgcatcagcaaagtcgtaatttttcagtctttccttcagcttctcgatttcccgttctttttcttccttcttcttaatcgtcaaataagcttcagtacgtttttcaatatcgccttttttcttatgtatgtcactttctctatacgctttggcattgtagtgaattggtgtagcgttctttcctttgcctgttgactcctgcagctttttaaaatcttgctgaatgaattgttcgttaggctctgttagtgcatattcagttgttaaatcatcatcgacttctccaattttattaattgttttttcgcgtttcttatctgcacttgcaagttcatctttaaagttttctgttgaaaacaaatcaagtggtaggatatcgtcaatatcgttcagaatgtccttcattgccttcttctgttcggacataatagcctttgattttttataagcattagctagttcatgctctaagaaagactcctcgacgtatgcatctgacaagctggcttcctctataactccagagatacttgtaaggaaagcaattttcatgtcaatcagatcgatccattggtctgtaacgccgacatgatcatgataaaatgctttaatgttgtctgcgcccttacctgaaaactcgctgtcctccaggtttgctacgtctttaaatgcttttctgagcctaaccatttgtgatctgaattccttgtactcttttgcacgtttatccgcttcagaaagtaatgactttgcttcaaataccttcataccattctcctttttctgacactcaacactcaaaattttaccatagtttaggagagttaacgggtttaagatcggacaaataccagaaatcctccaatcgaaatagttatttatactcaatacattgtttagaaaaggacatttccttataatcgatatacaagacctaggcaatctgttctttcgtatcttgaaaattaggcatgatcagcttgaaaaagatcaggacgccataaatgataagtacgacattttaacgaaatgacgaaagagcatttaagaagattgaagacaaacttatgaatggaaagataactgatatcaccaagcaatttgaacgagttttcaaagtttattaacagtaatatggagtctatcggtaagagtatttcaaacaaccttgttgataagctaaaagaggcttcaaatgcactctccgcagtagtaagggaacacaaccgttaaaaaagtatcgtcatttgatacaggtggatacacaggaacaggcttaggtgctggcaagcttgcattcctgcatgacaaagaactgatcttaaataagacagatacagagaacatgcttcaagctgtaaaagaagtacgtaagctatctaatagtgatttagtagctgagaagcaagttaaacccgacctaagcaagtacaaagatattctcagttctgtatcgtttgcagaaacttggattgccaaacctaaatgcaaatgtaaagacgaatgttccaaattccatagtgaacaataacactgaaaactcaacgattaataatgatgtaaaactccaatttacaatcactgaagccagcaatgcaaaagaaactgcaagcttagtttataaagagtcacaaatgggctgaaaaacaaagggttgaattttaatatggtataacagggtcgtatttctcattcgtatattgagtgggaagtacgtctttttttgtttatttttccctcggaatgcaccataatttaagaggagatgtttgtgattatttagaaatgtagtggattatttgaaaagtatatttgatttagtttcttttagtgaaaggattgcagatataccaaggtcagtggataatataataaatccaatagtgcaatttaaagagattctaagtgaatctaggttagttgttgatactgaaacaataatacatgaagacttaaaacctgttctaaatcacaccgcaaattttggttggacatatgtggatcatttgcctgcagatgaatgttttcaaaagagttactagatttaaataaggatcagattgatgaacactttatgtctttatatagtgaggcaaataaatataaggaagattttctagggacagcaaagcaatttgtttttgaaaacgttaatgaaattcaccatgatctacttaaagaaatgtacatggcttttgagaaaggtttgtataaactatgtatcccatctgcgatcttgataatcgaaggggaaattagtgatattgcccaaagttcagatgttggaaaaaggttgattactaaatgggaaacaaaactgcgtaagaaaaataattctaaatttgataaagagaaaacagattttatggacattgcaacatattcccttataaagtacttatcagagcgtttatttattgggcatgaatttgaagatgacaggttagatttattaaatcgaaattggattttacatgggagagacgattcgtctttgtggtcaaaaacagatgtagtaaggttgttaaacacaatttgtacggtggtaacaattaaagatcataatcaccaaaacaaatagatggtttgatttgttactaaaaaaatcaatggatttaagcttacaaacaagagataagtaaccccctcacagtaaagtgaaggggtatttttattgtttatattctgaagaatccacgcaccctgaaaaaccctgatagatcataagggtattttagggttgatcagggcgtagggatgtgctatatttataatcatatcatccctcagggatgtgtgagggtcaaggagggacgtaagtatgttcaattataatgtgaatatttttcaaatgaaatcaaaacctcatggaattgaaagactgaatgaatttattaacacgaatgaaaatggcctttccttcgtggctattggatggccaggtataggtgatttaaccaacaagagcaaaaaagagataagagaccttctgattgagaaatatgaatatgaaggacaacaactagcaaattatttgggcgcagttaatgcatttgtaaacactgtgaaaaatgaagacttggttttaatttctaataatcttgatcaagtatttgtatttgaagttggaaattataagtatgtaaaggaatatgataatgatatcgatggaatgtgtcatcaaagagaagcgaatttacttgtaatcctaaataagtctgacttggtaccagaacttcaggaattgctcaggaatagaggtacaattactcaatttaaatatccttttgagaaatccggattggataaatggttagaacctgataactcagagcttaattttaaattggatgatttgataaataaatccctaagcacattggaaaaggaattgctgtctgatgatgcaatggttcgaataaatgctgctaaagagatattgcgttatgctgcaaaagaatcatagtaggataacgcatatagtttcattcaaggctgtcaataattttgacagctgatttctttttcacatttggaattcttaatctccctattcaaacattttccgattacatacgataattattagagaatactttatattttcaatcctgcatttaatggaaaaaatttaatgattagagggaaatatgatgacaatttacgaacaaataaaaaccgttttacataataaagtcaataagttagttacacctcaagaagtaaagaaaacccttcaagagaaatatggaactaatccggatagcgttattttatctgattattgttataaccggtataataaggggatttcttttaataagcacctctttgaatatgtgaatagaagttcgtacaagtacttaggtgaagattctctatatacgggacttattttccgaaaatcaaaaggagaagaaaaggaagttctcgtaggcgaatgggtaaacggtgttaaatcactccaagaagcacctataactaaccaaataaatgataaagctgaaatcattagtaaagaacaacttgtaaacctttattatgaatataaccaaatcttgagatatgaaatgaatatattaaactgtaagcctacagaattgagacatttaactggtaggattggtgaattcatttgcacaattcaaacaaatggctctttagctcgcaaaactaatcaacatggttttgatgttctaagtgatggcagacgtattagtgtaaaaacaacagctcaatcaagtggtgatattcctattaataaaaatacatttgataactttgacgacttttttgtagttcaatacgaaaatgatgattttaaagttatttattttggcccgaaggaagaagtgaaaacaattagtagagtatcggggagcaaatatgaagttagtattggacaactaaagaaacttaatagggagtatcaattaaataaaacaattgtttgataacaaataacccctcacaataatgtgaaggggtgttttttaatactcacataatttatcttcgcattcaggttttcgggtagcatttactttaaatactccaacttcatcatttgccttatcgtatattccccagatttttttgtctttgtttccgtttaaatagccattaattgaaataccacccattggatttacttcataatcattggtgtattcaattgactgtatatctttatagtttgtttcaataaaatcattcattctttttttagccaaagagtacaactcttccttttgctgagtttcttgggcttccatttttttgtcgtgttgttccttcataaatatccctccaagtgttataataaccagagctataaggataattatgtattttttcataaaaccatcctttctgtcttacattttacatgagggaaggggtattgtacatgaatataaagactgacatacctaatttaacagataaggaatactatttcctgagtcaatatacgtatgatgataagagtctaaaagagagttatgtgaataaagatcctattgagaccacatctaataaagctttttatgtagataaaatcaaaaaagatccagatacagggctagatgtatacgtctttgttcaagccaagaaaaaagaaggtaaatgggtaaaaccaaaagaaccagaaaatgtcgttgtaggttttcaaggaacaaaccaggaacaaattcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttatgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccaccagtccttccggtctggcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcattggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctaatcccgtttcgctcgccgctactcagggaatcgcatttgctttctcttcctccgggtacttagatgtttcagttccccgggtctgccttctcatatcctatgaattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactatgtgatatcttgtaatcagcttgaaaaagatcaggacgccataaatgataagtacgacattttaacgaatgacgaaagagcatttaagaagattgaagacaaactcatgaatggaaagataactgatatcaccaagcaattgaacgagttttcaaagtttattaacagcaatatggagtctatcggtaagagcatttcaaacaaccttattgataagctaaaagaggcttcaaatgccctctccacagtagttaaggggaacacaaccggtaaaaaagtatcgtcatttgatacaggcggatacactggaacaggcttaggtggtggtaagcttgcgttcctgcatgacaaagaactgatcttaaataagacagatactgagaacatgcttcaagctgtaaaagaagtacgtaagttgtctaaaattgatttagacgctgaaaagcaagttaaacctgacctaagcaagtacaaagatattctaagttctgtatcgtttgcagctgggaaacttggattgccaaacctaaatgcaaatgtaaagacgaatgttccaaattccatagtgaacaataacactgaaaactcaacggttaataatgatgtaaaactccaatttacaatcactgaagccaacaatgcaaaagaaacagcaagcttagtttataaacaattagcaaatgggcttagaaattctggacttaattttaatatgaattaatacattttggagagaacgttgcgaatcgttttctccgatcattttttgttcaaaatctgtacatgtaatacgtttgccacctaatgatgcaaattcaatttgactacaaaacttgtttttattgtaaattaataaggaataatgtagaattataggcaattaatgtcctctgggggggagttacttgccaactgaaagaactgatgagtttgattttgtaacgattgatgaagtctttgtaccccaaattgttcaaactaaagatggggttagctatgttattgaaacagaagacataattagtcttaccgaagaacaattcaaccaagtgaagagtgaagtgttaaaaagaacatcttcctctgttgaaaaaaatggtgtagatattaaaacattaactcatgaacaggtagaggctattttagacgagattttgaatatagtaggaaattctgaaaacccttttgctgacggattaataaatctttctggtcatgtacaatttgatcacatgaacaacccaagtttattaaaagatagaggttggtatcatgaggacaatgatgaaattaggaaagaaatagtaagtgctgttaaagaagcatttgatgtagagaaagctaaattaaaatttaatcccaaaactaagaaaaccaagccaacgtttacttttacaattctagggtataaacgaaataaggataaaggtaaattatctgttgtggttataaaggattcagaggactctgttcttgtagtaaccattttatgatggtactattatgtaaagacccgattagggaggggaaaatatggcgacactaactgtatctgcaagtaaagttggtggtagtattagacctgctaaaatgttatgtgaatgtggtgaaaaagcatctcttagctactttaacaaaattggccgttttggtaattcttttgtgacggtgaagaatgtgccggtctacaagtgctcagaatgcgatgaagaaatcgttagaggcgcagattcattaaaattttttgaaaaaactaaagaagccgtaaaaaaaggtttaaccgagattgaatttgaataagttttcctacataaaagttatctaactatggattatatataattgctactccctatgaaggagtagcatttttttggattaagagcttttattgatgaattcgatagccacactcgcaaataaaatgtacatgtttattgccaagccaattacagacataattagtcgattttctttgacatgaagggcaaggtacgccaggtttaatattaggttcgccttcatactgttcataaatctctaatacatcatcaaacattttaagaactctttttagttcctcatcaagctcttttgtatttatttctttgctcatctttttcacctccccacttagtagtctaagttcttatctaatacaaaaaagcccactttcgccacaagtgacgatgacgccatattggagccttcgaaaaaaggcatcactaaagacaaccccttaattcaggagcataggctgactttatttaattgtaaggagacctgcaaagtgcagatcccttctcttaaactgctaaaacttcatcatctgctttccataagattaaaatgtctacatactcttttctaaaggaatcttcatcattcttgattacaatgcattcaactacatcaacatctggatatttctttttaacatctgcaacaaagtaaggcagagtttttttataatcacaagataagccagaaattaaacacttgttcttcctgtcataagacttcaataagtaagaataataaaatgattccattcaatgcatccccttgattaaattgtaaactggaagatgttattgaatttgttgaggacgattctaaagactcttaagcaaaagtattgcttttattttttaatttgttgaacaaaaccattgaaatattcgattgtccataaatgtggacaatcaaaagtattgcaatagctgttatactgtacgttaggtaaatgtgtagcaagacgtgttgcaggtgaaattatgagaagtttgttcaagtaatctacactgactgagctcccacattttttatttgatatgtgctatgctttttacataccaaataaaggggggctttcaattgacaacttctcatgaaatttctgtttctgtggggaatgaatttagacgttccaaaagctttagatcacgtagggaagcatgtaattccttgaaagtattagattaaagtttgtagataaagaggtattgccatcggatgagggattcccacgattcaacgtgtatgtaaagtattgtcatagtcacctggggaaagtaagaaaaggtataatggcaccacttggtacgcctcatagccatttccctgcagaattagaaagcgaagtattgacgtttatggaagaagaatacttaaaacgataaataaaaaacccttcacattgttgtgaggggattcttttttatctaaatatttagaattacatctattattttaaattttatatggtataattaaacatgagaaaataatcctctactacatagaaaggatgatccaaatatcaaagaatatttaacaattattatcaatctatcttctttaatagttacctttttgtccttgttactgaatgttggtttatttatcatgggtttactgacattcttagaaggaagaatcggtaagaaaattaagattaagtgtcttttgaccgtcctttcaagaaaaataaaaagaacagtcaaaagaacattcaaaagaattaaaaagtaatcttctaaagaccagagtggagcaacactttggtctttatattcctttagattacgatatttcgtaaatccattataacatgaatatatagtgaataaataattttttttgaaaaaagatttattttttcaaaaaaaatatttttaccgaaaaacatatcctccttcaaattttaatttatttagttttaatacttctcagaaaaacacttctgttctcagtggcatttgtaagcattgtcgcattttcattaagcctttgcactaatgcttctttagctttcccttcaaatgaagagagtaaagcaacatacacttcagctataacctgttgagctgaagaaaagtctgatgcgttttttgtgtcttcttttagattctggcaatgagtttttaaacttgaacccacaattttttttaattcctcattttgttgcaaccgtctgtaaaactcatctgcatccatattaactccatatggcaatttaaatcccccttataaccgtaaccagcttgctaattcattatccttatcttttttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattgatttgttcctggtttgttccttgaaaacctacgacaacattctcaggctcttttggtttaacccatttgccatcttttttctttgcttggacaaatacgtaaacatctaggcctgtatctgggtcttttttgattttatctatgaaatattgttttcctgaattaatctttacgggtatgtttttcgagaaatgttttttcaaatactcatctcgataagttagttgactaatactataataatcttggtcagatatattaggaaccttagccttcttgctcatgtacattgacacgctcctcatgtaaaataagcactgaaaggatggttttatgaaaaaatacattattatcctgttgtcagcaatcatcattataacacttggaggaatatacatgaaacaccaatatgatgaaaagcaagaaaaagttaagactgcagaactagagctatttgataaagctaaaaaacgaatgactgattacataaatgctaactatgaaggtataaataaaattgagttctcggacaaatatgaaatagacccaatgggtggtattaatgcagaggggtatttgaacggtaacaaagaaaaagagttttgggggatttatgacaagtcaaatgacactataacatcgtcttatgttgatgctaaagaaaagccagaatgcgaagataagccatgtgaatattaagtgaaaatcccctcacaataatgtgaaggggttctttggctttcattaatcttcccaatcttcatcttcttcccagttttctttcatctcatgaagcctttcataaaagaacttaataaaatgcgccgaatcaagttctttatagccaccaaattcactccaaataacaactggacattctccttcactgttcattttattggtatctaagcaataaccaaaaaaatcaacatgctctataactaccaatccacttggcaattccctatattcacgatattccctggttgtctcaacaactgaagcaccaccaaagtcatagcctaataaatcgattccataaactccaccagaaccatagtttctaagaaaccatttgtagctaactggaagtgtgacttgaagattttgctctatttttaaaattttatcttccccgattccacctgtgaaatcattttcttttgtattttcagcaaagaattcttttacttttaaataaaaatccatggcttataaccccttatttagagatactcgtaaggaaagcgatcttcatgcatactcctttttatgacaatcagtactcgaaattttaccatagtgtaggagagttaatgtcatcattatccttcaatcaccagaaatactcctgaggaaatagtcatttttactcaatcgattgtctgggaaatgacattttcttataatcgatatacaagacctaagcaatccagtcttcacaccctgaaaattaggtaacatccatcccgtatctttgcgagattggtttacatttacatccaaggaataccccagcattcgattatgccttacaagaacaacgtcagcgttattcacgacctgaactgcaactaaatctcctttgtacacacagcacgattcattttcaaagttatagttgtaaatattcggaatgaagtcggagaactttttattgatcgcacttgcgagtgagtcttttgtgtaaatatagtaatttaaaagttccccacctaggttgtacacagatatagccggcctcccattacttttaccgtgtgacatgaataggaatccatcgtttagggttataccttgtaccttctccaagttaggtatatagtctacagtaaaatcggtgtatagaacgggattccccatctttatcgattcccaagtgtacacataagcatgaatactggcttgatttacggttatcgaagcaaaatagtatttgttagccgcatatttactacttacattagctataattaaatccgagagttctcctgtatcataattaaaaatattatatccagccctttttgaagctttaacgataaagcataaattatcttggtcattataaaaaaatgacagcccctcagtgtatgcgccagattctatagggattgattttctttctttgaaactacctgtatcaagatcgcgaatttcaattctcagttctgttccttcattttcttgtgaagcaacatagatttcatttgtcagctcgtttatatttgcagattgcggccaaaataaagcttcttcccgcgccttaaatgtagtcatcgcttcaacattattcaaatagcttaaagcatcctgcgaattggttattaattcaaccgtcctgtacatttctgctagttgattcttaatttctcccttatctgcatctaatctttctttcaatacaggatacacaaaaccatcatcgtctacgcgcgcatccacaacctcttttatgttggttccgtccatttcaggagtccagagtttgtcatcataataatcttttattgtttcgtaccaatcactcatttaatcacaccacctgttaacagcttgaatgtgaggtcagatacttgctttttaagcttgtctagctctgatggttcgggaggcggaggctgtaagctgtcgatgtattcttgtgtagctgtttcgcgccattccgatttgcctttatcgaacaccggtttatacatgccggcgccgtcgggattaacaggagggatatctgtgtacccttccggaatctcctcgccgtcattgataatcatattttctgatggcacataattcattttgttgtcgtatttgtatatttgtttcatttgataacgcctcctctacagcgctttaaacgcgaaatcaaatttaatatagttcgtgttactggatacgctttctacgatgacttccccagtagatttgtatgcaatccgagcaacctgtgccgatcctgatgctatttgtatacaacccatagatcgtggcggccgcatgttttcagggagtgtaaaaacagtcgttccaacaacgcctccttttgcttcccctcgcacccatactgttttcgacgcatcaattccaaaaactacatcttcgccgccgttgtagtgagaccagccgttctgcaaagtcgcaacaacccacgaaaagttagatacgtaagtcttggcgtcagcaagcgccttatccgctttttcttgcgcgccattcgttgtttctttagcgttccaagctgttcgctcatcagccgtgatatgccgtgtagtatcatcgtcatgcgccttaaattctatcttactcgcctgctgcacgtcatctacattcgataagccaatctgcgcttttgttaccttgtgaggattatccgtcttagctgcgtgttcggacgtataagcctttgcgttagcttccgctgtatctgccttttcttgcgctccctctttcgtttcaatttggtcgagatcggagaacttcgcttttaattcgtccagaattgctgtttcttcgtcatacatcgctatgattaacgcctttaatgattcgaaatcatcgacgtaatactctgcgagagatgcgatgttctggtccgcaaggctttgcgatacttcaaacccgaatttgtgagcagagagtgcttggccgttcgcatatttcagaatgagttgacagttgaatttgccatacattttgatttcgtcctcatctaaaacatactctgcgatacctttcaacggatcaactatcgtgacatctcgtattctctgcttaccgctggacggaacgaggataacttttccagtcacggctgatagtggcaatgggatgccgtccttgcgtaaataaaatatcaactttgccgtattgatatcttgcgttgaaaatataaaagatgattggtaattcccttctgttattgcgtttatatcgaacgcgtaagagccgtttttataaatagccaatatccgttacctccctttaaatagtcgccgcgtacattaattcaaataccattcaaaaacaattgggtaccaggaattcacatcaggagtagggtgccttgtggataatattttcactttcccatttggttggatttgacaaacggcattgtgccctcctgatgttggaatcgtaaagggcaacactctatcgggcgaccactcaggatagtaacttatatactctgtgtccatagtcgttacgccttttagttcggcctctagtcgtattttattccctattcttcgtattcttggtttgcgttctggaacgtaggcagtcgcaccatttaataattctatgttgacatagaattattaaatggtgcgactgcctacgttccagaacgcaaaccaagaatacgaagaataggtaataaaatacgactagaagctgaactaaaaggcgtaacaactatggacacagagtatataagctattatcctgattggtcgcccgatagagtgctgccctttacgattccaacatcaggagggtacaatgccgtttgtcaaatccaacctaatggaaaagtgaaaatattatccacaaggcaccctactcctgatgtgaattcttggtacccaattgtttttgagtggtatttgaattaatgtacgcggcgactatttaaagggaggtaacgatattggctatttataaaaacggctcttacgcgttcgatataaacgcaataacagaagggaattaccaagcatcttttatattttcaacgcaagatatcaatacggcaaagttgatattttatttacgcaaggacggcatcccattgccactatcagcagtgactggaaaagtaatcctcgttccgtccagcggtaagcagagaatacgagatgtcacgatagttgatccgttgaaaggtatcgcagagtatgttttagataaggacgaaatcaaaatgtatggcaaattcaactgtcaactcattctgaaatatacgaacgggcaatcactctctgctcacaaattcgggtttgaagtatcgcaaagtcttgcagaccagaacatcgcacctctcgcggaatattacgtcgatgatttcgaatcattaaaggcgttaatcatagcgatgtatgacgaagaaacagcgatgctcgacgaattaaaagcgaagttctctgatctcgaccgaattgaaacgaaagagggagcgcaagaaaaggcagatgaagcggaagttaatgcgtataaaacagcagaatgttgagactgctgaaaattattttaaagaagtcagatctttatttgatgacatggaggaagatcaagaagtattgatgtattattctctacttgaagagaggcataaaatgatgatgtatcaagtaaaggggacagactttccaaagcactcctacttcaacaaaagacatgcaagagaaattcaaaaaacagataacatgattgagtactacttctttttgtttgaagcgttatacgaatcctacaatcgcaactttgagaatgccataagcttatttaaaattgcagagaaaaagttatcgattattcccgatgaaattgaagtcgctgaattttattctaaagttgcgtcaatgtacatgatgcttcgtcagagtattgtttcattaaattatataaacaacgcactcaatatttataaagggaatgaaaattacaaaaggaagtatgcaactgcacttatggttgtaggaactaactatacagatctaggccaatttgataaagcagaagaagcctatttccaagccattagaatttcaaaggagcttgatgataagttttttgaagcgcaaatccatcacaatttaagtattacatactcagcagcaaacagatcccaagactgtctcaacgcactgagaaaagccattagaaataaagaactctttatttcttatggcttttctcagtgcgttgagacagtcttgggatctgtttgctgctgagtatgtaatacttaaattgtggtgaatttgcgcttcgaaaaatttatcatcaagctcttttgaaattctaatggcttggaaataagcttcttcagctttatcaaattggcctagatctgtatagttagttccgacaaccataagggcagttgcatacttccttttataattttcattccctttataaatgttgagtgcgttgtttatataatttaatgaaacaatactttgccggagcatcatgtacattgacgcaactttagaataaaattcagcagcttcaatttcatcgggaatgatcgatagctttttctctgcgattttaaataagcttatggcattctcaaaatttcgattgtaggattcgtataacgcttcaaacaaaaagaagtagtactcaatcatgttatctgttttttgaatttctcttgcatgtcttttgttgaagtatgaatgctttggaaagtctgtcccttttacttgatacatcatcattttatgcctctcttcaagtagagagtaatacatcaatacttcctggtcttcttccatgtcatcaaataaagatttgacttctttaaaatatttttcagcagcctcaacattctgctgttttatgtggcgacaatcagtttattacattaactctctttacatggctaccaaagagttattcctcatggatcaaaaagataaagctgtatattattacaaaaaaggacaggaaaatttaacccagaaagagaataaagtgtatgaggctaaaataaacatcatttatgcacttcttcaagataatcaaaacgaaaccattgagcaatgttggagttacattcatttccttcaagaaaagaatgacttagacagtgttcttgatctttccttgattatctctcagtactgcgaggagaaagaatgttataaggatgctcttgaattttctaagcgagctattttagccgaaaagaaaatgaggcagttggagggaataggatgaaaagattaatacttcgtgtgtctgttacagctattatcttaagtgggttagctgctggtgctagtttgtttactcagtcagacattcaatttagtgaaaaaccagtcggaactgatatccagattgcagaaagaccagttggaacttaataaaaagtgaggggcataagatgacaaaaggcgttaaaataaccttgtggagcatcctagccgtatttatcgtgttagcaataataggagttgtagcttattatcagaccccatcagcgtaaaaaagcagacctctaaagaacagccctataagcttaaccatatttttgaatgatgtcacacctgttatctagttttgagagaataagtttttcaaaaaaacacttgattttctcaagaatacatagtataatgttaaatgtcactgaaattgtctggtgatgatggcgaagaggtcacacccgttcccatgccgaacacggaagttaagctcttcagcgccgatggtagtcgggggtttccccctgtgagagtaggacatcgccaggcagacttcattccgcagtagctcagtggtagagctatcggctgttaaccgatcggtcgtaggttcgaatcctacctgcggagccattattggagagctgtccgagtggtcgaaggagcacgattggaaatcgtgtaggcggtcaactccgtctcaagggttcgaatcccttgctctccgccactgatacttatacataattacaattgaaagtctgggcccgttggtcaagcggttaagacaccgccctttcacggcggtaacacgggttcgaatcccgtacgggtcattatatgatggaggattagctcagctgggagagcatctgccttacaagcagagggtcggcggttcgagcccgtcatcctccaccattattaggaatatgtatggcggaggaagagggattcgaacccccgcgggctttgacacccctgtcggttttcaagaccgatcccttcagccagacttgggtattcctccgtatagtggtggaccttgtaggactcgaacctacgaccggacggttatgagccgtctgctctaaccaactgagctaaaggtccattggtagcggcggaggggatcgaacccccgacctcacgggtatgaaccgtacgctctagccagctgagctacaccgccaaatattttttgaaaccaagtggagcctagcgggatcgaaccgctgacctcctgcgtgcaaagcaggcgctctcccagctgagctaaggccccaagaatggtcgggaagacaggattcgaacctgcgaccccatggtcccaaaccatgtgctctaccaagctgagctacttcccgatttcatatagatcatggcgcgcccgagaggagtcgaacccctaaccttttgatccgtagtcaaacgctctatccaattgagctacgggcgcaaaacttaaatcctcagccattttaacaataaactcactaatatcctctaaatctctaatcaaataatgaagagaagcctcagtttgatactgttcttctgagtcataaaatgctgccccatctttcacataaggtgcgtgaaacaatacagctttatcaacatcacttggatctagatccttgaactctcctaatctcttcccacaaatagattttacgtcgtaaaccattttgctgtgatcatgaggaaatcgttcaattgcttgtttctttgtttttaagtcttcgatagctgcctgtaatcgtttagctaattcttttgcatactttgcatccactttaattgtctggccattcatgcctgagaaagatgagaatgattcgatattctggttataaacaccgttgctgccatcaacactctggatattaccattcttatcaaatttaaagttcgaatcatttaaactatgagtatcaggattttttgcaaatgcttggccatagaaggaagtaataagactccctaaaacaccaggaatagctcttcagcgccgatggtagtcgggggtttccccctgtgagagtaggacgccgccaagcagatttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagctttattaaatgtattattaccaaggtttctcataaggagaaagctttttttattgcgatatgcggaagtagttcagtggtagaacaccaccttgccaaggtgggggtcgcgggttcgaatcccgtcttccgctccaattatcccaacgggatattgtaaattgaattgcgcccgtagctcaattggatagagcgtttgactacggatcaaaaggttaggggttcgactcctctcgggcgcgccatatcttttaatagaatagatagggtcctcaagaaaacgctcctccgttaatgccggccgattcaaataacctctggcaacacccgctccggcaatgtatagttcgccggcgacaccggaaggctgtacggctaaatgcggatctaaaacatacaaacgcgcaccaggtacgggcttcccaatcggaatccgcaaacggtctctgtcccgttctggatccaatacgtaaaatgccgcgtctaccgttgcttctgtcggcccgtagccatggattaatgatacctgcggcaatacagaagcaaaacgggctgccgtacggggcgcaagcggttcacctccggcgaatacacgctttaggtttgtcccgtcaccaagcgccaacatttctgcttgatccagaaagctattcagcatagccggaataaaatgagccgttgtcactttttcctgatgaatggcttttacgatcaatgcggagtctttttcccagccgggcggaagcagatacgccgaagcaccggaaagagacctagagacgtattaagccggtttgcacgatcttgacgtgagatgctagggtctttcgtgtatatcgttgttccgttgtgtcggtcgtattctaaaaaccaacctgaacccaccatatcatcaggattaattattgctttgtgatacagatcaaattcgccatttctgattttcttctgtgtttcttcatcgtgcagcttaacaatggaagggttattaaaagctacactgtaaacgttattgtttacaccagcgtattctgcatctgcccctccaagtgaatgacctgttgtcgaaatcactgtgttagtgccagcatactttttcacttcattggcaacgatcttatcaccttgatcaaattgagatgtcttagtgacaattttgtattctccactcttaatcatcatcgcttgttccatagcccaaagatgtattaagtcggtttgcacgatcttgacgtgcgatgcttgggtctttcgtgtatatagttgttccgttgtgtctgtcgtattctaaaaaccaacctgaacccaccatatcatcaggattaatgattgctttatgatacaaatcaaattcgccatttctgattttcttctgtgtttcttcatcatgcagcttaacaatagaagggttgttaaaagccacactgtaaacgttgttgtttacaccagcatattctgcatctgctcccccaagtgagtgacctgtggtcgaaatcactgtgttagcgccagcatactttttcacttcattggcaacaatcttatcaccttgatcaaattgagatgtcttagtaacaattttgtattctccgctcttaatcatcatcgcttgttccatgcaagtatggaggattagctcagctgggagagcatctgccttacaagcagagggtcggcggttcgagcccgtcatcctccaccatttttcattatacatatcggttttacatatatgccggtgtagctcaattggtagagcaactgacttgtaatcagtaggttgggggttcaagtcctcttgccggcaccacttttatatgatataatattcaagtctcttgtaagaagagccattagctcagttggtagagcatctgacttttaatcagagggtcgaaggttcgagtccttcatggctcaccatttacatgttgcggatgtggcggaattggcagacgcgctagaatcaggctctagtgtctttacagacgtgggggttcaagtcccttcatccgcaccattcaggatgtccagtttttctaactgttatcctatataatgcgggtgaagggacttgaacccccacgtcataaagacactagatcctaagtctagcgcgtctgccaattccgccacacccgcgtaaaatggtgagccatgaaggactcgaaccttcgaccctctgattaaaagtcagatgctctaccaactgagctaatggctcttctacaagagacttgagtattatatcatataaaagtggtgccggcaagaggacttgaacccccaacctactgattacaagtcagttgctctaccaattgagctacaccggcataatggtggaggatgacgggctcgaaccgccgaccctctgcttgtaaggcagatgctctcccagctgagctaatcctccataattgtccatcctttcagggttgagcttcccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacctcttttagcggcacctgtacatcgaattctttggagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgcgttttacccgggtgaacgtatgtacaaaacaggggatgtggcgcgctggctccctgacgggaatgttgaattcctcgggcgtacggatgatcaggtgaaaatccgcggctaccggattgagccgggagaaattgaagcggcactaagaagcatagaaggcgtaagagaggcggccgttaccgtacggacagacagcggcgagccggaattatgcgcttatatagaagggctccaaagaaacgaagtccgggcgcagcttgaaagactgctgccgggctacatggtcccagcctatatgatagagatggaacagtggccggttacaccaagcggaaagcttgaccgaaacgccctgccagctcctgacggagcggcagatgcggagacctacacgtgtgtaggtctccgcatctgccgctccgccaggagctggcagggcgtttcggtcgagttttccgcttggcgtaaccggccactgttccatctctatcatataggctgggaccatgtagcccggcaacagtctctcaagctgcgctcggacttcgtttctttggagcccttctacataagcgcataattccggctcgccgctgtctgtccgtacggtaacggccgcctcccttacaccttctatacttcttagtgccgcttcaatttctcccggttcaacccggtagccgcgaattttcacctgatcatccaaccgtcccaggaattcaacattcccgtcagggagccagcgcgccacatctcctgttttgtacatacgttcacccgggtaaaatgcagcgccggaagattccgattattgtacagctcgccgaattcccgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgcggcctcctgttcggttcgtgcgccgagaactgtagtctgtaacgtaaacggcgcctcgtcatggatgcgctgcaccggatcgcctcctgcgtcctgtttgaaggaggtccgaagcgactcgtggcgcttgatcagctctttgaaagctctgttgtagagcttctttccattttgtattgctgcggtctttaatgaattcatctaatgcttcctgctgttcttgaagctgtttctccaggtctttgacttgagctttcgcttcatcagaatcatccattgaaagcttattaattttatctttggtttcctggatggcttgattcttctcttttaattccttctgatacttagcttcggcatcttctttgtcgatttcatcaatcttatcttgtgtcgctttccagtaatcaaactacattcgatagatatggccatgcaacaataaaattagctgataagacagctgaatttcccaacaattttttacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccattatcccttgagtttaattgcgtcatcacgaaagcagaattgcgctatgtcgaaaattttttctatatattacatttaatgttaaagttgtgttaacatttgtttgataatttagaattttgacagaaagaggggtttattatgagtaaacttgcttctgaatatgttgctaatttcttaaatgaatggtatatggctctgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattaggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagtttttaatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttctctctaaaggcggaaggtaaggaaactccgctaagggctctcacatcctgtgagaaacgcccagtaccttcatcctgaaggcatttgtttggtggcgatagcgaagaggtcacacccgttcccataccgaacacggaagttattaatggcagctttcgcctttcagatgcatgtgtaaatagggaaacacagaaggcatcctatcctcatttattgcgtcggctgagtcactaccctgtcaagttttacgtgtgttagcgcattccacggcagtctctgccgttatacttggcaatggctttagagttttcagatgcatcttttttcattatgtattggactttctttttcgggtctttacccattactacgttgccgccatctgcacttataacatcagcttttgggtcttataaacagaacgttccctgtcttgtttagttttgaaggatcattccttcgaaacgtgttctttgaaaactagataacagtagacatcacattcaattagtaattgttttgcgcccgtagctcaattggatagagcgtttgactacggatcaaaaggttaggggttcgactcctctcgggcgcgccatatcttttaatagaatagatg
